US010280199B2

(12) United States Patent
Kim

(10) Patent No.: US 10,280,199 B2
(45) Date of Patent: May 7, 2019

(54) CORONAVIRUS PROTEINS AND ANTIGENS

(71) Applicant: Phibro Animal Health Corporation, Teaneck, NJ (US)

(72) Inventor: Byoung-Kwan Kim, Mankato, MN (US)

(73) Assignee: Phibro Animal Health Corporation, Teaneck, NJ (US)

( * ) Notice: Subject to any disclaimer, the term of this patent is extended or adjusted under 35 U.S.C. 154(b) by 51 days.

(21) Appl. No.: 15/228,898

(22) Filed: Aug. 4, 2016

(65) Prior Publication Data

US 2016/0339097 A1    Nov. 24, 2016

Related U.S. Application Data

(63) Continuation-in-part of application No. PCT/US2015/015009, filed on Feb. 9, 2015, and a continuation-in-part of application No. PCT/US2016/017183, filed on Feb. 9, 2016.

(60) Provisional application No. 61/937,419, filed on Feb. 7, 2014, provisional application No. 62/209,538, filed on Aug. 25, 2015, provisional application No. 62/113,976, filed on Feb. 9, 2015, provisional application No. 62/113,979, filed on Feb. 9, 2015.

(51) Int. Cl.
| C07K 14/005 | (2006.01) |
| A61K 39/12 | (2006.01) |
| A61K 39/00 | (2006.01) |

(52) U.S. Cl.
CPC ............ *C07K 14/005* (2013.01); *A61K 39/12* (2013.01); *A61K 2039/552* (2013.01); *C12N 2770/20011* (2013.01); *C12N 2770/20034* (2013.01); *C12N 2770/20051* (2013.01); *C12N 2770/20071* (2013.01)

(58) Field of Classification Search
CPC .................. C07K 16/10; A61K 39/215; A61K 2039/552; A61K 2039/70; C12N 2770/10064; C12N 2770/20011; G01N 2333/165; C07D 211/62; Y10T 436/24
See application file for complete search history.

(56) References Cited

U.S. PATENT DOCUMENTS

| 7,241,582 B2* | 7/2007 | Joo ...................... C07K 14/005 435/7.4 |
| 7,449,296 B2 | 11/2008 | Jung |
| 7,776,537 B2* | 8/2010 | Joo ...................... C07K 14/005 435/6.16 |
| 8,142,788 B2 | 3/2012 | Kim |
| 9,388,218 B2* | 7/2016 | Joo ...................... C07K 14/005 |
| 9,950,061 B2* | 4/2018 | Hernandez .............. C07K 16/10 |
| 2005/0220814 A1 | 10/2005 | Dominowski et al. |
| 2011/0038900 A1 | 2/2011 | Chakrapani et al. |
| 2011/0177116 A1 | 7/2011 | Wasmoen et al. |
| 2013/0302370 A1 | 11/2013 | Fachinger et al. |
| 2014/0004041 A1 | 1/2014 | Bey et al. |
| 2014/0179594 A1 | 6/2014 | Fischetti et al. |
| 2014/0255442 A1 | 9/2014 | Burgard et al. |
| 2015/0283229 A1 | 10/2015 | Hernandez et al. |

FOREIGN PATENT DOCUMENTS

| WO | WO 2002/074940 | 9/2002 |
| WO | WO 2003/096463 | 11/2003 |
| WO | WO 2007/00006031 | 1/2007 |

OTHER PUBLICATIONS

International Search Report dated May 22, 2015, from International Application No. PCT/US2015/015009.
International Search Report dated Jul. 26, 2016, from International Application No. PCT/US2016/017183.
Lawrence et al., "Genome sequences of porcine epidemic diarrhea virus: in vivo and in vitro phenotypes," *Genome Announcements* 2(3):1-2, May/Jun. 2014, Jun. 12, 2014.
Oh et al., "Comparison of an enzyme-linked immunosorbent assay with serum neutralization test for serodiagnosis of porcine epidemic diarrhea virus infection," *Journal of Veterinary Science* 6(4):349-352, Dec. 1, 2005.
Song et al., "Porcine epidemic diarrhoea virus: a comprehensive review of molecular epidemiology, diagnosis, and vaccines," *Virus Genes* 44(2):167-175, Jan. 22, 2012.
Takamura et al., "Protection studies on winter dysentery caused by bovine coronavirus in cattle using antigens prepared from infected cell lysates," *Canadian Journal of Veterinary Research* 64:138-140, Apr. 1, 2000.
Takamura et al., "Field study of bovine coronavirus vaccine enriched with hemagglutinating antigen for winter dysentery in dairy cows," *Canadian Journal of Veterinary Research* 66:278-281, Oct. 1, 2002.
Chen et al., "Method for obtaining membrane protein involves infecting animal host cells with rhabdovirus Bacmid CMV-G-HA, forming cyst membrane utilizing host cell substances during budding of virus, separating virion and freeze thawing," Derwent No. 2009-E71195, Derwent Abstract of CN 101348800 published Jan. 21, 2009.
Di-qiu et al., "High-level mucosal and systemic immune responses induced by oral administration with *Lactobacillus*-expressed porcine epidemic diarrhea virus (PEDV) S1 region combined with *Lactobacillus*-expressed N protein," *Applied Genetics and Molecular Biotechnology* 93(6): 2437-2446, 2012.

(Continued)

*Primary Examiner* — Bao Q Li
(74) *Attorney, Agent, or Firm* — Klarquist Sparkman, LLP

(57) ABSTRACT

Disclosed herein are embodiments of a method for collecting, extracting or eluting proteins and antigens from cells infected with coronavirus. The coronavirus may be a porcine coronavirus, such as porcine epidemic diarrhea virus (PEDV) or porcine delta coronavirus (PDCoV). Also disclosed are embodiments of a composition comprising the coronavirus proteins and antigens, and embodiments of a method of using such a composition. Applications for the composition include, but are not limited to, use in the preparation of antibodies against the proteins and antigens, use as reference markers for coronavirus proteins, and/or use in an immunogenic composition, such as in a vaccine composition.

20 Claims, 11 Drawing Sheets

Specification includes a Sequence Listing.

(56) References Cited

OTHER PUBLICATIONS

Egberink et al., "Characterization of the structural proteins of porcine epizootic diarrhea virus, strain CV777," *American Journal of Veterinary Research*, 49(8):1320-1324, Aug. 1988.
Hernandez et al., "Porcine epidemic diarrhea virus derived DNA (45-28031)," Sequence alignment of nt 20000-24000 of SEQ ID No. 1 with Geneseq Database Access No. BCF33575.
Park et al., "Receptor-bound porcine epidemic diarrhea virus spike protein cleaved by trypsin induces membrane fusion," *Archives of Virology* 156:1749-1756, 2011.
Shaikh et al., "Mucoadhesive drug delivery systems," *Journal of Pharmacy and Bioallied Sciences*, 3(1):89-100, Jan.-Mar. 2011.
Song et al., "Oral efficacy of Vero cell attenuated porcine epidemic diarrhea virus DR13 strain," *Research in Veterinary Science* 82:134-140, 2007.

* cited by examiner

|  | Born alive (litter average) | Pigs remaining at weaning (litter average) | Piglet mortality |
| --- | --- | --- | --- |
| Vaccinated sows – 10hd – 2cc dose | 133 (13.3) | 113 (11.3) | 15% |
| Non-vaccinated sows – 33hd | 405 (12.2) | 291 (8.8) | 28% |

FIG. 3

|  | # litters | Born alive (litter average) | Pigs weaned (litter average) | Pre-weaning mortality |
|---|---|---|---|---|
| Entire rooms vaccinated | 128 | 1466 (11.4) | 1324 (10.3) | 9.6% |
| No vaccine used in rooms | 88 | 1059 (12.0) | 872 (9.9) | 17.6% |

FIG. 4

|  | Farm 1 | Farm 2 | Farm 3 | Farm 4 | Farm 5 | Farm 6 | All farm average |
|---|---|---|---|---|---|---|---|
| Day 1-7 | 100 | 99 | 97 | 100 | 97 | 100 | 98% |
| Day 8-15 | 98 | 94 | 98 | 98 | 100 | 100 | 98% |
| Day 16-23 | 51 | 47 | 78 | 89 | 90 | 100 | 76% |
| Day 24-31 | 23 | 24 | 34 | 54 | 45 | 100 | 46% |
| Day 32-39 | 19 | 14 | 27 | 43 | 34 | 100 | 39% |
| Day 40-47 | 19 | 25 | 17 | 30 | 16 | 22 | 21% |
| Day 48-55 | 24 | 12 | 18 | 27 | 20 | 37 | 23% |
| Day 56-63 | 19 | 11 | 16 | 25 | 19 | 32 | 20% |
| Individual farm average prior to PEDV | 15% | 14% | 15% | 20% | 17% | 12% | |

FIG. 5

Case 1  Case 2  Case 3  Case 4
Std S P P P S P P P S P P P S P P P kDa
220 --
120 --

Std, Protein Molecular Weight Standard
S, Sow serum samples
P, Piglet serum samples

1. 2x diluted sample
2. 3x diluted sample
3. 4x diluted sample
4. Fully grown virus culture itself
S. SeeBlue Protein MW Standard
M. Magic Protein MW Standard
CO. PEDv isolate from sample taken in Colorado
IA. PEDv isolate from sample taken in Iowa
NC. PEDv isolate from sample taken in North Carolina

FIG. 7

1. DE sample from CO-virus culture
2. DE sample from IA-virus culture
3. DE sample from NC-virus culture
4. Mix of 3 DE samples before inactivation process
5. Mix of 3 DE samples after inactivation process
6. Mix of 3 virus cultures in equal volume
S. SeeBlue Protein MW Standard
M. Magic Protein MW Standard

CORONAVIRUS PROTEINS AND ANTIGENS

CROSS REFERENCE TO RELATED APPLICATION

This application is a continuation-in-part of International Application No. PCT/US2015/015009, filed on Feb. 9, 2015, which in turn claims the benefit of the earlier filing date of U.S. Provisional Patent Application No. 61/937,419, filed on Feb. 7, 2014. This application also claims the benefit of the earlier filing date of U.S. Provisional Patent Application No. 62/209,538, filed on Aug. 25, 2015, and of International Application No. PCT/US2016/017183, filed on Feb. 9, 2016, which in turn claims the benefit of the earlier filing dates of U.S. Provisional Patent Application Nos. 62/113,976 and 62/113,979, both filed on Feb. 9, 2015. Each of these applications is incorporated by reference herein in its entirety.

FIELD

This disclosure relates to the preparation and isolation of coronavirus proteins and antigens, particularly from porcine coronaviruses. The disclosure further provides viral proteins and antigens as obtained from coronavirus infected cells and compositions comprising the proteins and antigens.

BACKGROUND

Coronaviruses are a family of RNA viruses that infect avians and mammals, including humans and swine. Coronaviruses belong to the family Coronaviridae, which has four main sub-groupings, known as alphacoronavirus, betacoronavirus, gammacoronavirus and deltacoronavirus. Human coronaviruses include alphacoronaviruses 229E and NL63, and betacoronaviruses OC43, HKU1, SARS-CoV (the coronavirus that causes severe acute respiratory syndrome, or SARS), and MERS-CoV (the coronavirus that causes Middle East Respiratory Syndrome, or MERS). Porcine coronaviruses include alphacoronaviruses, such as transmissible gastroenteritis virus, porcine respiratory coronavirus, and porcine epidemic diarrhea virus (PEDV); betacoronaviruses, such as porcine hemagglutinating encephalomyelitis virus; and deltacoronavirus, such as porcine deltacoronavirus (PDCoV). Other coronaviruses include, but are not limited to, bovine coronavirus (BCV), feline coronavirus (FCoV), canine coronavirus (CCoV), avian infectious bronchitis virus (IBV), and turkey coronavirus (TCV). Porcine coronaviruses are important diseases in swine production. For example, PEDV is a highly infectious coronavirus that infects the intestinal system of a pig, typically causing diarrhea and dehydration. While adult pigs mostly become sick and lose weight after becoming infected, the virus is often fatal to newborn piglets. Infected herds can suffer a loss of from 50% to 100% of the piglets for a four to five week period. It has been estimated that between June 2013 and March 2014 over 4 million piglets were lost to PEDV in USA.

SUMMARY

This disclosure relates to proteins and antigens from a coronavirus. The coronavirus can be any coronavirus currently known, or later discovered. In certain embodiments, the disclosure relates to coronaviruses that infect avian or mammals, including, but not limited to, humans, and swine. The coronavirus may be a porcine coronavirus, and may be selected from transmissible gastroenteritis virus, porcine respiratory coronavirus, PEDV, porcine hemagglutinating encephalomyelitis virus, or PDCoV. Particular embodiments concern proteins and antigens from PEDV, and other particular embodiments concern proteins and antigens from PDCoV.

Disclosed herein are embodiments of a method of preparing coronavirus proteins and/or antigens, such as PEDV or PDCoV proteins and/or antigens, from cells infected with a coronavirus, such as PEDV or PDCoV. In some embodiments, the proteins and/or antigens are harvested at an early time point after infection when the majority, or entirety, of the viral proteins and/or antigens remain associated with the infected cells. In such embodiments, the majority or entirety of coronavirus encoded proteins are either within the infected cells or associated with the cell membrane of the infected cells. Under such conditions, relatively few, if any, coronavirus particles are present in the extracellular environment outside the cells. In other embodiments, the proteins and/or antigens are harvested at a stage after infection when at least some of the infected cells have released replicated coronavirus viral particles into the extracellular environment.

Certain embodiments of the disclosed method may include providing a population of cultured cells infected with a coronavirus, such as PEDV or PDCoV; isolating and/or separating the coronavirus-infected cells from the culture medium and/or cell-free coronavirus in the medium; and collecting coronavirus proteins and/or antigens from the isolated cells. Collecting viral proteins and/or antigens may be done by extracting or eluting them from the isolated, infected cells with a detergent-containing solution. In some examples, the detergent-containing solution comprises an amount of detergent effective to extract or elute the proteins and/or antigens, such as 0.5% Triton X-100. In additional embodiments, the collecting, extracting or eluting may be for up to 24 hours, such as 2 to 15 hours or in some embodiments, from 0.2 to 5 hours. The collecting, extracting or eluting is performed at a temperature suitable for the collecting, extracting or eluting, such as from 0° C. to 25° C., from 2° C. to 10° C., from 2° C. to 6° C. or, in certain examples, 4° C. Optionally, the coronavirus proteins and/or antigens produced by the method may include coronavirus envelope proteins, such as PEDV envelope proteins or PDCoV envelope proteins.

Also disclosed herein are isolated coronavirus proteins and/or antigens, such as PEDV or PDCoV proteins and/or antigens, prepared by the disclosed method. The viral proteins and/or antigens may include one or more envelope proteins produced by an infected cell. Compositions comprising the viral proteins and/or antigens are also contemplated. Optionally, the composition may contain one or more adjuvants, and/or additional excipients, such as a pharmaceutically acceptable carrier.

Embodiments of a method of producing an immune response in a subject, such as a porcine subject, are also disclosed. The method may include administering one or more coronavirus proteins and/or antigens, prepared by the disclosed method, to the subject. The one or more coronavirus proteins and/or antigens may comprise one or more proteins and/or antigens from a single coronavirus. Additionally, or alternatively, the one or more coronavirus proteins and/or antigens may comprise proteins and/or antigens from one or more coronaviruses, such as, for example, PEDV and PDCoV. In certain embodiments, the method comprises administering one or more PEDV or PDCoV proteins and/or antigens to a porcine subject. Optionally, producing an immune response may comprise vaccinating the subject. In some embodiments, a composition comprising the proteins and/or antigens is administered to the subject. The method may also include one or more repeated administration(s) of the proteins and/or antigens, or the composition, to the same subject, such as 2, 3, 4 or more administrations.

Embodiments of a kit comprising the isolated proteins and/or antigens is disclosed herein. The kit may comprise a composition comprising the coronavirus proteins and/or antigens. In some embodiments, the kit is suitable for use in a method of producing an immune response in, or a method of vaccinating, a subject.

The various aspects of the disclosure are contemplated for use in relation to all coronavirus strains that are antigenically identical, or related to, those isolated in North America, Europe and Asia. Therefore, the disclosure may be more generally viewed as based on the protein(s) and/or antigens of any coronavirus isolate, strain or subtype.

The foregoing and other objects, features, and advantages of the invention will become more apparent from the following detailed description, which proceeds with reference to the accompanying figures.

BRIEF DESCRIPTION OF THE DRAWINGS

FIG. 3 is a table of data comparing the mortality of piglets from non-vaccinated sows and sows vaccinated 3-5 days pre-farrow with an exemplary embodiment of a PEDV vaccine disclosed herein, where the non-vaccinated and vaccinated sows and litters are kept in the same room.

FIG. 4 is a table of data comparing the mortality of piglets from non-vaccinated sows and sows vaccinated 3-5 days pre-farrow with an exemplary embodiment of a PEDV vaccine disclosed herein, where the non-vaccinated and vaccinated sows and litters are kept in separate rooms.

FIG. 5 is a table of data from multiple farms, providing baseline piglet mortality data from non-vaccinated herds.

FIG. 6 is a Western blot illustrating the detection of antibodies against 180-kDa to 350-kDa of PEDV spike protein.

FIG. 7 is a Western blot of three MARC-cell based detergent extracts of PEDV isolates, illustrating the proteins present in the extracts.

FIG. 8 is a Western blot of the three detergent extracts of FIG. 7 and mixtures of the extracts before and after viral inactivation, illustrating the proteins present before and after inactivation.

FIG. 9 is a table illustrating the PEDV sequence homology between SEQ ID NOS: 1-9.

FIGS. 10A-10C are tables illustrating the PDCoV sequence homology between SEQ ID NOS: 18-63.

FIG. 10A is a table illustrating the PDCoV sequence homology concerning 15 strains.

FIG. 10B is a table illustrating the PDCoV sequence homology concerning another 15 strains.

FIG. 10C is a table illustrating the PDCoV sequence homology concerning another 16 strains.

SEQUENCE LISTING

Figure 1:
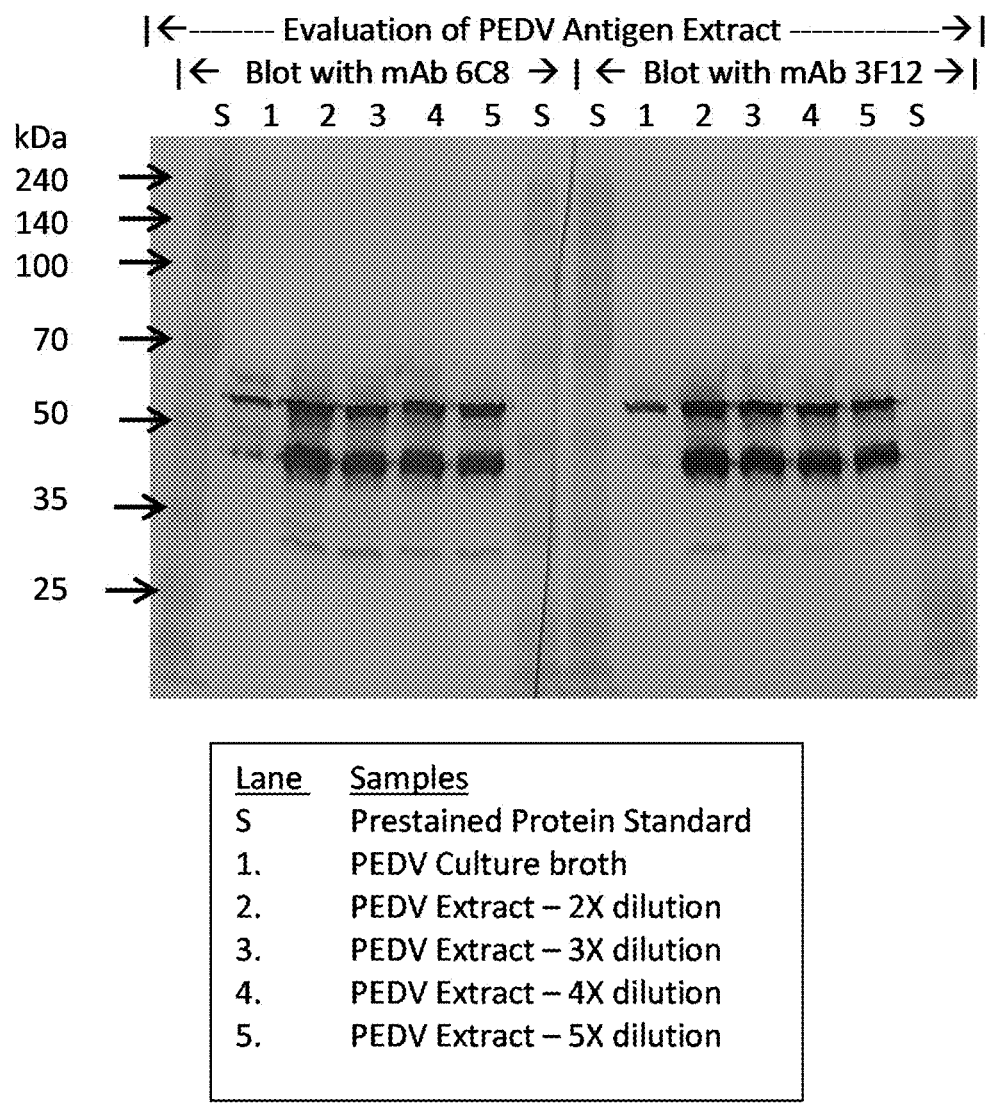
FIG. 1 is a Western blot of PEDV proteins from cultures of infected cells, contacted with two monoclonal antibodies.

The nucleic and amino acid sequences listed in the accompanying sequence listing are shown using standard letter abbreviations for nucleotide bases, and three letter code for amino acids, as defined in 37 C.F.R. § 1.822. Only one strand of each nucleic acid sequence is shown, but the complementary strand is understood as included by any reference to the displayed strand. The Sequence Listing is submitted as an ASCII text file, created on Aug. 4, 2016, 1.86 MB, which is incorporated by reference herein. In the accompanying sequence listing:

SEQ ID NO: 1 is the nucleotide sequence of North American PEDV strain Colorado 2013 (GenBank Accession No. KF272920).

SEQ ID NO: 2 is the nucleotide sequence of North American PEDV strain Iowa/18984/2013 (GenBank Accession No. KF804028).

SEQ ID NO: 3 is the nucleotide sequence of North American PEDV strain North Carolina USA/NC/2013/35140 (GenBank Accession No. KM975735).

SEQ ID NO: 4 is the nucleotide sequence of North American PEDV strain Indiana12.83/2013 (GenBank Accession No. KJ645635).

SEQ ID NO: 5 is the nucleotide sequence of North American PEDV strain Iowa/2013 (GenBank Accession No. KJ645649).

SEQ ID NO: 6 is the nucleotide sequence of North American PEDV strain 1251-125-10.

SEQ ID NO: 7 is the nucleotide sequence of Korean PEDV strain SM98 (GenBank Accession No. GU937797).

SEQ ID NO: 8 is the nucleotide sequence of Korean attenuated PEDV strain KR-DR13-att (GenBank Accession No. JQ023162).

SEQ ID NO: 9 is the nucleotide sequence of Chinese PEDV strain AH2012 (GenBank Accession No. KC210145).

SEQ ID NO: 10 is the deduced amino acid sequence of the S protein encoded by SEQ ID NO: 1 North American PEDV strain Colorado 2013.

SEQ ID NO: 11 is the deduced amino acid sequence of the S protein encoded by SEQ ID NO: 2 North American PEDV strain Iowa/18984/2013.

SEQ ID NO: 12 is the deduced amino acid sequence of the S protein encoded by SEQ ID NO: 3 North American PEDV strain North Carolina USA/NC/2013/35140.

SEQ ID NO: 13 is the deduced amino acid sequence of the S protein encoded by SEQ ID NO: 4 North American PEDV strain USA/Indiana12.83/2013.

SEQ ID NO: 14 is the deduced amino acid sequence of the S protein encoded by SEQ ID NO: 5 North American PEDV strain USA/Iowa/2013.

SEQ ID NO: 15 is the deduced amino acid sequence of the S protein encoded by SEQ ID NO: 6 North American PEDV strain 1251-125-10.

SEQ ID NO: 16 is the deduced amino acid sequence of the S protein encoded by SEQ ID NO: 7 Korean PEDV strain SM98.

SEQ ID NO: 17 is the deduced amino acid sequence of the S protein encoded by SEQ ID NO: 8 Korean attenuated PEDV strain KR-DR13-att.

SEQ ID NO: 18 is the nucleotide sequence of Korean PDCoV strain KOR/KNU14-04/2014 (GenBank Accession No. KM820765).

SEQ ID NO: 19 is the nucleotide sequence of North American PDCoV strain USA/Iowa459/2014 (GenBank Accession No. KR265865).

SEQ ID NO: 20 is the nucleotide sequence of North American PDCoV strain USA/Illinois121/2014 (GenBank Accession No. KJ481931).

SEQ ID NO: 21 is the nucleotide sequence of North American PDCoV strain USA/Minnesota454/2014 (GenBank Accession No. KR265854).

SEQ ID NO: 22 is the nucleotide sequence of North American PDCoV strain USA/Minnesota455/2014 (GenBank Accession No. KR265855).

SEQ ID NO: 23 is the nucleotide sequence of North American PDCoV strain USA/Arkansas61/2015 (GenBank Accession No. KR150443).

SEQ ID NO: 24 is the nucleotide sequence of North American PDCoV strain USA/Minnesota/2013 (GenBank Accession No. KR265853).

SEQ ID NO: 25 is the nucleotide sequence of North American PDCoV strain 8734/USA-IA/2014 (GenBank Accession No. KJ567050).

SEQ ID NO: 26 is the nucleotide sequence of North American PDCoV strain USA/NorthCarolina452/2014 (GenBank Accession No. KR265858).

SEQ ID NO: 27 is the nucleotide sequence of North American PDCoV strain HKU15 MI6148 (GenBank Accession No. KJ620016).

SEQ ID NO: 28 is the nucleotide sequence of North American PDCoV strain HKU15 OH11846 (GenBank Accession No. KT381613).

SEQ ID NO: 29 is the nucleotide sequence of North American PDCoV strain USA/Illinois272/2014 (GenBank Accession No. KR265856).

SEQ ID NO: 30 is the nucleotide sequence of North American PDCoV strain USA/Illinois273/2014 (GenBank Accession No. KR265857).

SEQ ID NO: 31 is the nucleotide sequence of North American PDCoV strain HKU15 IL2768 (GenBank Accession No. KJ584355).

SEQ ID NO: 32 is the nucleotide sequence of North American PDCoV strain USA/Nebraska209/2014 (GenBank Accession No. KR265860).

SEQ ID NO: 33 is the nucleotide sequence of North American PDCoV strain USA/Nebraska210/2014 (GenBank Accession No. KR265861).

SEQ ID NO: 34 is the nucleotide sequence of North American PDCoV strain HKU15 NE3579 (GenBank Accession No. KJ584359).

SEQ ID NO: 35 is the nucleotide sequence of North American PDCoV strain USA/Illinois449/2014 (GenBank Accession No. KR265852).

SEQ ID NO: 36 is the nucleotide sequence of North American PDCoV strain USA/Minnesota159/2014 (GenBank Accession No. KR265859).

SEQ ID NO: 37 is the nucleotide sequence of North American PDCoV strain USA/Michigan447/2014 (GenBank Accession No. KR265849).

SEQ ID NO: 38 is the nucleotide sequence of North American PDCoV strain USA/Michigan448/2014 (GenBank Accession No. KR265850).

SEQ ID NO: 39 is the nucleotide sequence of North American PDCoV strain PDCoV/USA/Iowa136/2015 (GenBank Accession No. KX022602).

SEQ ID NO: 40 is the nucleotide sequence of North American PDCoV strain PDCoV/USA/Nebraska145/2015 (GenBank Accession No. KX022605).

SEQ ID NO: 41 is the nucleotide sequence of North American PDCoV strain PDCoV/USA/Nebraska137/2015 (GenBank Accession No. KX022604).

SEQ ID NO: 42 is the nucleotide sequence of North American PDCoV strain PDCoV/USA/Minnesota140/2015 (GenBank Accession No. KX022603).

SEQ ID NO: 43 is the nucleotide sequence of North American PDCoV strain HKU15 PA3148 (GenBank Accession No. KJ584358).

SEQ ID NO: 44 is the nucleotide sequence of North American PDCoV strain USA/Indiana453/2014 (GenBank Accession No. KR265851).

SEQ ID NO: 45 is the nucleotide sequence of North American PDCoV strain USA/Minnesota292/2014 (GenBank Accession No. KR265864).

SEQ ID NO: 46 is the nucleotide sequence of North American PDCoV strain USA/Minnesota214/2014 (GenBank Accession No. KR265848).

SEQ ID NO: 47 is the nucleotide sequence of North American PDCoV strain USA/Minnesota442/2014 (GenBank Accession No. KR265847).

SEQ ID NO: 48 is the nucleotide sequence of North American PDCoV strain HKU15 SD3424 (GenBank Accession No. KJ584356).

SEQ ID NO: 49 is the nucleotide sequence of North American PDCoV strain USA/Ohio444/2014 (GenBank Accession No. KR265862).

SEQ ID NO: 50 is the nucleotide sequence of North American PDCoV strain USA/Ohio445/2014 (GenBank Accession No. KR265863).

SEQ ID NO: 51 is the nucleotide sequence of North American PDCoV strain HKU15 KY4813 (GenBank Accession No. KJ584357).

SEQ ID NO: 52 is the nucleotide sequence of Chinese PDCoV isolate PDCoV/CHJXNI2/2015 GenBank Accession No. KR131621).

SEQ ID NO: 53 is the nucleotide sequence of Chinese PDCoV strain CH/SXD1/2015 (GenBank Accession No. KT021234).

SEQ ID NO: 54 is the nucleotide sequence of Chinese PDCoV isolate CHN-JS-2014 (GenBank Accession No. KP757892).

SEQ ID NO: 55 is the nucleotide sequence of Chinese PDCoV isolate CHN-HB-2014 (GenBank Accession No. KP757891).

SEQ ID NO: 56 is the nucleotide sequence of Chinese PDCoV isolate CHN-HN-2014 (GenBank Accession No. KT336560).

SEQ ID NO: 57 is the nucleotide sequence of Chinese PDCoV strain NH (GenBank Accession No. KU981059).

SEQ ID NO: 58 is the nucleotide sequence of Chinese PDCoV strain NH isolate passage 0 (GenBank Accession No. KU981060).

SEQ ID NO: 59 is the nucleotide sequence of Chinese PDCoV strain CH/Sichuan/S27/2012 (GenBank Accession No. KT266822).

SEQ ID NO: 60 is the nucleotide sequence of Chinese PDCoV isolate CHN-AH-2004 (GenBank Accession No. KP757890).

SEQ ID NO: 61 is the nucleotide sequence of Thailand PDCoV strain PDCoV/Swine/Thailand/S5011/2015 (GenBank Accession No. KU051641).

SEQ ID NO: 62 is the nucleotide sequence of Thailand PDCoV strain PDCoV/Swine/Thailand/S5015L/2015 (GenBank Accession No. KU051649).

SEQ ID NO: 63 is the nucleotide sequence of Thailand PDCoV isolate TT_1115 (GenBank Accession No. KU984334).

DETAILED DESCRIPTION

I. Definitions

The following explanations of terms and methods are provided to better describe the present disclosure and to guide those of ordinary skill in the art in the practice of the present disclosure. The singular forms "a," "an," and "the" refer to one or more than one, unless the context clearly dictates otherwise. The term "or" refers to a single element of stated alternative elements or a combination of two or more elements, unless the context clearly indicates otherwise. As used herein, "comprises" means "includes." Thus, "comprising A or B," means "including A, B, or A and B," without excluding additional elements. All references, including patents and patent applications cited herein, are incorporated by reference.

Unless otherwise indicated, all numbers expressing quantities of components, molecular weights, percentages, temperatures, times, and so forth, as used in the specification or claims are to be understood as being modified by the term "about." Accordingly, unless otherwise indicated, implicitly or explicitly, the numerical parameters set forth are approximations that may depend on the desired properties sought and/or limits of detection under standard test conditions/methods. When directly and explicitly distinguishing embodiments from discussed prior art, the embodiment numbers are not approximates unless the word "about" is recited.

Unless explained otherwise, all technical and scientific terms used herein have the same meaning as commonly understood to one of ordinary skill in the art to which this disclosure belongs. Although methods and materials similar or equivalent to those described herein can be used in the practice or testing of the present disclosure, suitable methods and materials are described below. The materials, methods, and examples are illustrative only and not intended to be limiting.

The terms "administer," "administering," "administration," and the like, as used herein, refer to methods that may be used to enable delivery of compositions to the desired site of biological action. These methods include, but are not limited to, intravenous, intramuscular, intradermal, intraperitoneal, subcutaneous, intravaginally, orally, topically, intrathecally, inhalationally, intranasally, transdermally, rectally, and the like. Administration techniques that can be employed with the agents and methods described herein are found in e.g., Goodman and Gilman, *The Pharmacological Basis of Therapeutics*, current ed.; Pergamon; and Remington's, *Pharmaceutical Sciences* (current edition), Mack Publishing Co., Easton, Pa., which are incorporated herein by reference.

Certain methods of administration deliver the immunogenic composition to mucosal membranes. These include, but are not limited to, intranasal, oral, intravaginal, and rectal. In some embodiments, an adjuvant is selected to facilitate administration to mucosal membranes, and/or stimulate a mucosal immune response. The adjuvant may adhere to the mucosal membrane. Mucosal immune responses typically comprise the production of IgA antibodies but may also stimulate IgG responses, which may be advantageous in certain disclosed embodiments.

Intranasal formulations may include vehicles that neither cause irritation to the nasal mucosa nor significantly disturb ciliary function. Non-adjuvant diluents such as water, aqueous saline or other known substances can be employed with the subject invention. The nasal formulations may also contain preservatives such as, but not limited to, chlorobutanol and benzalkonium chloride. A surfactant may be present to enhance absorption of the subject proteins by the nasal mucosa.

Oral liquid preparations may be in the form of, for example, aqueous or oily suspension, solutions, emulsions, syrups or elixirs, or may be presented dry in tablet form or a product for reconstitution with water or other suitable vehicle before use. Such liquid preparations may contain conventional additives such as suspending agents, emulsifying agents, non-aqueous vehicles (which may include edible oils), or preservative.

As used herein, the terms "co-administration," "administered in combination with," and their grammatical equivalents, are meant to encompass administration of two or more therapeutic agents to a single subject, and are intended to include treatment regimens in which the agents are administered by the same or different routes of administration or at the same or different times. In some embodiments the one or more compositions described herein will be co-administered with other agents, including, but not limited to, therapeutics such as other vaccines, antibiotics, or combinations thereof. These terms encompass administration of two or more agents to the subject so that both agents and/or their metabolites are present in the subject at the same time. They include simultaneous administration in separate compositions, administration at different times in separate compositions, and/or administration in a composition in which both agents are present. Thus, in some embodiments, the compositions described herein and the other agent(s) are administered in a single composition. In some embodiments, the compositions described herein and the other agent(s) are admixed in the composition.

The term "effective amount" or "therapeutically effective amount" refers to the amount of an active agent (such as one or more compounds provided herein alone, in combination, or potentially in combination with other therapeutic agent(s)) sufficient to induce a desired biological result. That result may be amelioration or alleviation of the signs, symptoms, or causes of a disease, or any other desired alteration of a biological system. The term "therapeutically effective amount" is used herein to denote any amount of a therapeutic and/or preventative that causes an improvement in a disease condition. The amount can vary with the condition being treated, the stage of advancement of the condition, and the type and concentration of formulation applied. Appropriate amounts in any given instance will be readily apparent to those of ordinary skill in the art or capable of determination by routine experimentation such as vaccination and observation of an antibody response or vaccination followed by a challenge wherein the vaccinated animals perform better than non-vaccinated animals that are challenged similarly.

The compositions provided herein, alone or in combination with other suitable components, can be made into aerosol formulations (e.g., they can be "nebulized") to be administered via inhalation. Aerosol formulations can be placed into pressurized acceptable propellants, such as dichlorodifluoromethane, propane, nitrogen, and the like.

The disclosed compositions can be formulated for parenteral administration, such as, for example, by intravenous, intraarterial, intramuscular, intradermal, intraperitoneal, and subcutaneous routes. Examples of parenteral dosage forms include, but are not limited to, solutions ready for injection, dry products ready to be dissolved or suspended in a pharmaceutically acceptable vehicle for injection, suspensions ready for injection, and emulsions. In addition, controlled-release parenteral dosage forms can be prepared. Suitable materials for such administration include sterile water; saline solution; glucose solution; aqueous vehicles, such as sodium chloride Injection, Ringer's Injection, Dextrose Injection, Dextrose, Sodium Chloride Injection, Lactated Ringer's Injection; ethyl alcohol, polyethylene glycol, and propylene glycol; non-aqueous vehicles such as, but not limited to, corn oil, cottonseed oil, peanut oil, sesame oil, ethyl oleate, isopropyl myristate, and benzyl benzoate; aqueous and non-aqueous, isotonic sterile injection solutions, which can contain antioxidants, buffers, bacteriostats, and solutes that render the formulation isotonic with the blood of the intended recipient; and aqueous and non-aqueous sterile suspensions that can include suspending agents, solubilizers, thickening agents, stabilizers, and preservatives. In the practice of this disclosure, compositions can be administered, for example, by intravenous infusion, orally, topically, intraperitoneally, intravesically or intrathecally. In an independent embodiment, parenteral administration, oral administration, and/or intravenous administration are the methods of administration. The formulations of compounds can be presented in unit-dose or multi-dose sealed containers, such as ampules, bottles, and vials.

"Coronavirus protein," such as PEDV or PDCoV protein, as used herein in reference to disclosed embodiments refers to any polypeptide product encoded by the coronavirus genome and/or produced only as a result of coronavirus infection or the coronavirus lifecycle. As used herein, a "polypeptide" has a length of from 2 amino acids to a length of a protein encoded by the coronavirus or a cell infected by a coronavirus, such as from 6 amino acids to a length of a protein, and/or a length sufficient to produce an antigenic response in a subject administered the polypeptide. Thus coronavirus specific polypeptides not encoded by a host cell but expressed by a coronavirus infected cell are within the scope of the term. Endogenous polypeptides encoded by a coronavirus infected cell, but expressed in the absence of coronavirus infection and/or lifecycle, are not intended. However, endogenous polypeptides expressed only as a consequence of coronavirus infection and/or lifecycle are within the scope of the term. The term also includes alternative forms of the polypeptides due to changes in secondary and/or tertiary structure, such as those resulting from partial or substantial protein denaturation as a non-limiting example. Thus denatured forms of the polypeptides are within the scope of the term.

PEDV protein refers to any polypeptide product encoded by the PEDV genome and/or produced as only as a result of PEDV infection or the PEDV lifecycle. Thus PEDV specific polypeptides not encoded by or expressed by a PEDV infected cell are within the scope of the term. Endogenous polypeptides encoded by a PEDV infected cell, but not expressed in the absence of PEDV infection and/or lifecycle, are not intended. However, endogenous polypeptides expressed only as a consequence of PEDV infection and/or lifecycle are within the scope of the term. The term also includes alternative forms of the polypeptides due to changes in secondary and/or tertiary structure, such as those resulting from partial or substantial protein denaturation as a non-limiting example. Thus denatured forms of the polypeptides are within the scope of the term.

The term "antigen" refers to a compound, composition, or substance that can stimulate the production of antibodies or a T-cell response in an animal, including compositions that are injected or absorbed into an animal. An antigen reacts with the products of specific humoral or cellular immunity. For example, PEDV antigen refers to any portion or fragment of a PEDV polypeptide that is recognized by an anti-PEDV antibody. In some cases, the portion or fragment may be a peptide with an attached moiety, such as, but not limited to, a sugar moiety, a phosphate moiety, or a lipid moiety. Alternatively, the portion or fragment may be a peptide without any attached non-peptide moieties.

Coronavirus antigen, such as a PEDV or PDCoV antigen, refers to any portion or fragment of a coronavirus polypeptide that is recognized by an anti-coronavirus antibody. In some cases, the portion or fragment may be a peptide with an attached moiety, such as, but not limited to, a sugar moiety, a phosphate moiety, or a lipid moiety. Alternatively, the portion or fragment may be a peptide without any attached non-peptide moieties.

The term "excipient," as used in this disclosure, is an additive that is used in combination with the coronavirus antigens. An excipient can be used, for example, to dilute an active agent, such as the coronavirus antigens, and/or to modify properties of a pharmaceutical composition. Examples of excipients include, but are not limited to, water, magnesium stearate, stearic acid, vegetable stearin, sucrose, lactose, starches, hydroxypropyl cellulose, hydoxypropyl methylcellulose, xylitol, sorbitol, maltitol, gelatin, polyethyleneglycol (PEG), phosphate buffered saline (PBS), carboxy methyl cellulose, vitamin A, vitamin E, vitamin C, retinyl palmitate, selenium, cysteine, methionine, citric acid, methyl paraben, propyl paraben, sugar, silica, talc, magnesium carbonate, sodium starch glycolate, tartrazine, aspartame, benzalkonium chloride, sesame oil, propyl gallate, sodium metabisulphite, lanolin, polyvinylpyrrolidone (PVP), tocopheryl polyethylene glycol 1000 succinate (also known as vitamin E TPGS, or TPGS), dipalmitoyl phosphatidyl choline (DPPC), trehalose, sodium bicarbonate, glycine, sodium citrate, lactose, saline, phosphate buffered saline or organic buffers including but not limited to Tris (hydroxymethyl)aminomethane, and metal chelating agents. Metal chelating agents include, but are not limited to, organic compounds such as the amino acids glutamic acid and histidine, organic diacids such as malate, and polypeptides such as phytochelatin, biomolecules such as pyochelin, pyoverdine, enterobactin and Dopa, and synthetic chelates such as ethylenediaminetetraacetic acid (EDTA).

An adjuvant refers to an agent that modifies the effect of another agent. As used herein, an adjuvant may be added to an immunogenic composition, such as a vaccine, to facilitate a beneficial result obtained by administering the immunogenic composition, such as by modifying the immune response to increase the amount of antibodies produced and/or increasing the length of protection conferred by the vaccine. An adjuvant may also be added to a composition to help stabilize a formulation of proteins and/or antigens in a vaccine composition. In some embodiments, the adjuvant is a non-naturally occurring chemical. Typically water by itself is not an adjuvant. Examples of adjuvants include, but are not limited to, inorganic compounds, such as alum, aluminum hydroxide, aluminum phosphate, aluminum sulfate, or calcium phosphate hydroxide; mineral oil, such as paraffin oil; organic esters such as aryl or aliphatic esters, particularly alkyl esters such as linear alkyl esters having up to at least 25 carbons, preferably up to 10 carbons; esters of acids or of alcohols containing a linear alkyl group, such as plant oils, ethyl oleate, propylene glycol di-(caprylate/caprate), glyceryl tri-(caprylate/caprate) or propylene glycol dioleate; esters of branched fatty acids or alcohols, in particular isostearic acid esters; oil-in-water emulsions, such as MF59 (U.S. Pat. No. 6,299,884) (containing 5% Squalene, 0.5% Tween 80, and 0.5% Span 85, optionally containing various amounts of MTP-PE) formulated into submicron particles using a microfluidizer such as Model 110Y microfluidizer (Microfluidics, Newton, Mass.)), and SAF (containing 10% Squalene, 0.4% Tween 80, 5% pluronic-blocked polymer LI 21, and threonyl-MDP, either microfluidized into a submicron emulsion or vortexed to generate a larger particle size emulsion), EMULSIGEW-based adjuvants including EMULSIGEN®, EMULSIGEN®-D (containing dimethyldioctadecylammonium bromide (DDA)), EMULSIGEN®-BCL (containing a block copolymer immunostimulant) and EMULSIGEN®-P (containing with a proprietary immunostimulant), and EMULSIGEN®-75 (a double adjuvant comprising an oil-in-water adjuvant with a cross-linked polymer) (Phibro Animal Health Corporation, Omaha, Nebr., USA); saponins, such as Stimulon™ QS-21 (Antigenics, Framingham, Mass.), described in U.S. Pat. No. 5,057,540, ISCOMATRIX (CSL Limited, Parkville, Australia), described in U.S. Pat. No. 5,254,339, and immunostimulating complexes (ISCOMS); surfactants, e.g., hexadecyl amine, octadecylamine, lysolecithin, dimethyldioctadecylammonium bromide, N,N-dioctadecyl-N'-N-bis(2-hydroxyethyl-propane di-amine), methoxyhexadecyl-glycerol, and pluronic polyols; copolymers, including low molecular weight copolymers such as Polygen™ (available from Phibro Animal Health Corporation, Omaha, Nebr., USA); polanions, e.g., pyran, dextran sulfate, and poly IC; peptides, e.g., muramyl dipeptide, MPL, aimethylglycine, tuftsin, oil emulsions, alum, and mixtures thereof.

Unsaturated carboxylic acid polymers also may be useful as adjuvants for the disclosed compositions. Such polymers include polymers of acrylic or methacrylic acid, copolymers of maleic anhydride and alkenyl derivative and cross-linked acrylic acid polymers, such as polyacrylate or polyacrylic acid polymers, optionally cross-linked with polyalkenyl ethers of sugars or polyalcohols (carbomers). In certain embodiments, polymers comprising moieties having from 2 to 10 carbon atoms, more particularly 2 to 4 carbon atoms are preferred, e.g. vinyls, allyls and other ethylenically unsaturated groups. The unsaturated radicals may be optionally substituted, such as with one or more alkyl moieties including methyl. Such polymers include polymers are sold under the name carbopol (cross-linked with an allyl sucrose or with allyl pentaerythritol) including carbopol 934P, carbopol 971P and carbopol 974P (available from Lubrizol Corporation, Wickliffe, Ohio)) and the polymer sold under the name CARBIGEN™ (available from Phibro Animal Health Corporation, Omaha, Nebr., USA). Copolymers of maleic anhydride and alkenyl derivative include the copolymers EMA (Monsanto) that are copolymers of maleic anhydride and ethylene. In certain embodiments, an adjuvant comprising an unsaturated carboxylic acid polymer, such as an adjuvant comprising carbopol, or CARBIGEN™, are advantageous for administration to mucus membranes, such as via intranasal, oral, vaginal and rectal routes.

Other exemplary adjuvants include bacterial lipopolysaccharides; synthetic polynucleotides such as oligonucleotides containing a CpG motif (e.g., U.S. Pat. No. 6,207,646); IC-31 (Intercell AG, Vienna, Austria), described in European Patent Nos. 1 296 713 and 1 326 634; a pertussis toxin (PT) or mutant thereof, a cholera toxin or mutant thereof (e.g., U.S. Pat. Nos. 7,285,281, 7,332,174, 7,361,355 and 7,384,640); or an E. coli heat-labile toxin (LT) or mutant thereof, particularly LT-K63, LT-R72 (e.g., U.S. Pat. Nos. 6,149,919, 7,115,730 and 7,291,588); bacterial products, such as killed bacteria Bordetella pertussis, Mycobacterium bovis, or toxoids; B peptide subunits of E. coli heat labile toxin or cholera toxin (McGhee, J. R., et al., "On vaccine development," Sem. Hematol., 30:3-15 (1993)); nonbacterial organics, such as squalene or thimerosal; delivery systems, such as detergents (Quil A); cytokines and/or lymphokines, such as interleukins 1-a, 143, 2, 4, 5, 6, 7, 8 and 10, 12 (see, e.g., U.S. Pat. No. 5,723,127), 13, 14, 15, 16, 17 and 18 (and its mutant forms); the interferons-a, β and γ; granulocyte-macrophage colony stimulating factor (GM-CSF) (see, e.g., U.S. Pat. No. 5,078,996 and ATCC Accession Number 39900); macrophage colony stimulating factor (M-CSF); granulocyte colony stimulating factor (G-CSF); and the tumor necrosis factors a and β; chemokines, such as MCP-1, MIP-Iα, MIP-Iβ, and RANTES; adhesion molecules, such as a selectin, e.g., L-selectin, P-selectin and E-selectin; mucin-like molecules, such as CD34, GlyCAM-1 and MadCAM-1; a member of the integrin family, such as LFA-1, VLA-1, Mac-1 and p150.95; co-stimulatory molecules, such as CD40 and CD40L; immunoglobulin superfamily members, such as PECAM, ICAMs, e.g., ICAM-1, ICAM-2 and ICAM-3, CD2 and LFA-3; growth factors including vascular growth factor, nerve growth factor, fibroblast growth factor, epidermal growth factor, B7.2, PDGF, BL-1, and vascular endothelial growth factor; receptor molecules including Fas, TNF receptor, Flt, Apo-1, p55, WSL-1, DR3, TRAMP, Apo-3, AIR, LARD, NGRF, DR4, DR5, KILLER, TRAIL-R2, TRICK2, and DR6; Caspase (ICE); muramyl peptides, such as N-acetyl-muramyl-L-threonyl-D-isoglutamine (thr-MDP), N-acetyl-normuramyl-L-alanine-2-(1 '-2' dipalmitoyl-sn-glycero-3-hydroxyphosphoryloxy)-ethylamine (MTP-PE); the B peptide subunits of E. coli heat labile toxin or of the cholera toxin; the RIBI adjuvant system (Ribi Inc.); pluronic polyols; Amphigen; Avridine; L121/squalene; D-lactide-polylactide/glycoside; MPL™ (3-O-deacylated monophosphoryl lipid A, Corixa, Hamilton, Mont.; described in U.S. Pat. No. 4,912,094); synthetic lipid A analogs; aminoalkyl glucosamine phosphate compounds (AGP), or derivatives or analogs thereof (Corixa, Hamilton, Mont.; described in U.S. Pat. No. 6,113,918), including 2-[(R)-3-tetradecanoyloxytetradecanoylamino]ethyl 2-deoxy-4-O-phosphono-3-O—[(R)-3-tetradecanoyoxytetradecanoyl]-2-[(R)-3-tetradecanoyloxytetradecanoylamino]-β-D-glucopyranoside (529, RC529, optionally formulated as an aqueous form (AF) or as a stable emulsion (SE)); and combinations, such as Freund's complete adjuvant or Freund's incomplete adjuvant. Alternatively, or additionally, the proteins and antigens may be the incorporated into liposomes for use in an immunogenic composition, such as a vaccine, or may be conjugated to proteins, such as keyhole limpet hemocyanin (KLH) or human serum albumin (HSA) and/or other polymers.

The term "pharmaceutically acceptable carrier" refers to an excipient that is a carrier or vehicle, such as a suspension aid, solubilizing aid, or aerosolization aid. *Remington: The Science and Practice of Pharmacy*, The University of the Sciences in Philadelphia, Editor, Lippincott, Williams, & Wilkins, Philadelphia, Pa., 21$^{st}$ Edition (2005), incorporated herein by reference, describes additional compositions and formulations suitable for pharmaceutical delivery of one or more therapeutic compositions and/or pharmaceutical agents.

In general, the nature of the carrier will depend on the particular mode of administration being employed. For instance, parenteral formulations usually comprise injectable fluids that include pharmaceutically and physiologically acceptable fluids, such as water, physiological saline, balanced salt solutions, aqueous dextrose, glycerol, or the like as a vehicle. In some examples, the pharmaceutically acceptable carrier may be sterile to be suitable for administration to a subject (for example, by parenteral, intramuscular, or subcutaneous injection). In addition to biologically-neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

The term "immune response" refers to a response of a cell of the immune system, such as a B-cell, T-cell, macrophage or polymorphonucleocyte, to a stimulus such as an antigen. An immune response can include any cell of the body involved in a host defense response, including for example, an epithelial cell that secretes an interferon or a cytokine. An immune response includes, but is not limited to, an innate immune response or inflammation. As used herein, a protective immune response refers to an immune response that protects a subject from infection (prevents infection or prevents the development of disease associated with infection).

The terms "isolated proteins and antigens" and "isolated coronavirus proteins and antigens," as used herein, refers to proteins and antigens separated from the culture medium or supernatant. The isolated proteins and antigens typically comprise cell material, such as cell wall fragments, and proteins and antigens released from the infected cells, such as by a detergent or freeze-thawing. The isolated proteins and antigens may be in a buffer solution.

The term "substantial identity" in the context of a peptide indicates that a peptide comprises a sequence with at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%, sequence identity to a reference sequence over a specified comparison window. Optimal alignment is conducted using the homology alignment algorithm of Needleman and Wunsch, J. Mol. Biol. 48:443 (1970). An indication that two peptide sequences are substantially identical is that one peptide is immunologically reactive with antibodies raised against the second peptide. Thus, a peptide is substantially identical to a second peptide, for example, where the two peptides differ only by a conservative substitution.

The term "vaccine" refers to a preparation of immunogenic material capable of stimulating an immune response, administered for the prevention, amelioration, or treatment of disease, such as an infectious disease. The immunogenic material may include, for example, antigenic proteins, peptides or DNA derived from them. Vaccines may elicit prophylactic (preventative) and/or therapeutic responses. Methods of administration vary according to the vaccine, but may include inoculation, ingestion, inhalation or other forms of administration as discussed herein. Inoculations can be delivered by any of a number of routes, including parenteral, such as intravenous, subcutaneous, intramuscular, intranasal, oral, vaginal or rectal. Vaccines may be administered with an adjuvant to boost the immune response.

II. Overview

Coronaviruses are enveloped viruses and have a positive-sense single-stranded RNA genome. The coronavirus genome is typically from about 25 to 32 kilobases. Substantially all coronaviruses have spike (S) proteins, envelope, membrane, and nucleocapsid proteins that contribute to the overall viral structure.

With respect to porcine coronaviruses, PEDV is a member of the subfamily Coronavirinae of the genus Alphacoronavirus. It is an enveloped virus possessing approximately a 28 kb, positive-sense, single stranded RNA genome. Although first identified in 1971 in England, variant strains of PEDV emerging since 2010 in China, and since 2013 in North America, have been associated with large-scale outbreaks of diarrhea have been more acute and severe than those associated with the early European outbreaks. These recent Chinese and North American strains have been identified as belonging to Genogroup 2. Typically, the homology between strains in this genotype is very similar. For example, North American strains typically have about 99% homology. However, the North American strains and recent China strains have less similarity to strains from Europe and Asia that are Genogroup 1. For example, FIG. 9 shows a comparison of the homologies of seven Genogroup 2 strains from North America (SEQ ID NOS: 1-6) and China in 2012 (SEQ ID NO: 9). DR13, an attenuated Korean strain of Genogroup 1 (SEQ ID NO: 8), the sequence of which would be known to a person of ordinary skill in the art based on the disclosure provided by WO 2015/120378, incorporated herein by reference, as the sequence was known; and SM98, a Korean strain of Genogroup 1 (SEQ ID NO: 7). SM98 has 96.6 to 96.9% homology with the Genogroup 2 strains, but the Genogroup 2 strains are at least 99%, such as 99.1-99.9%, homologous with each other.

Figure 10A:
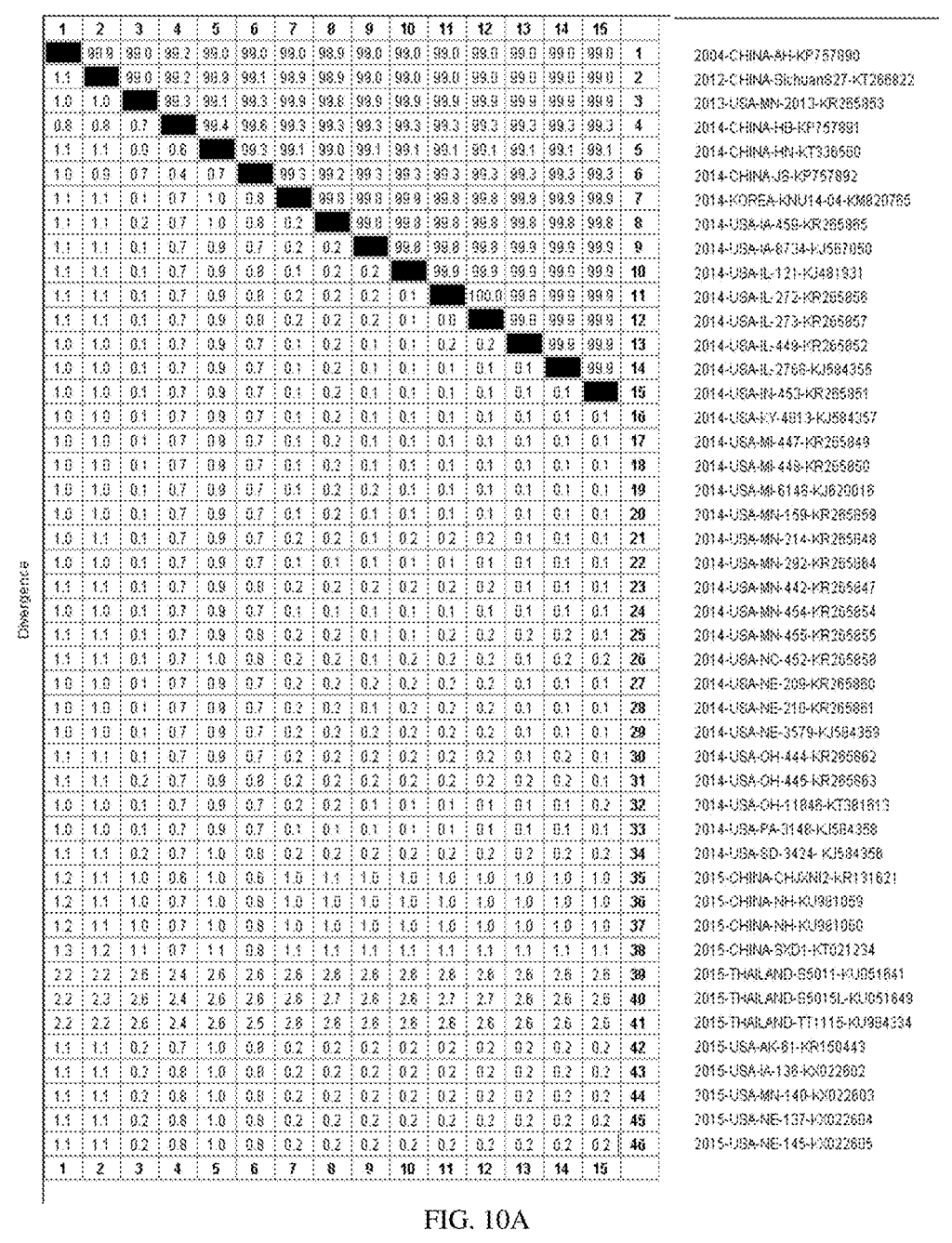
Figure 10B:
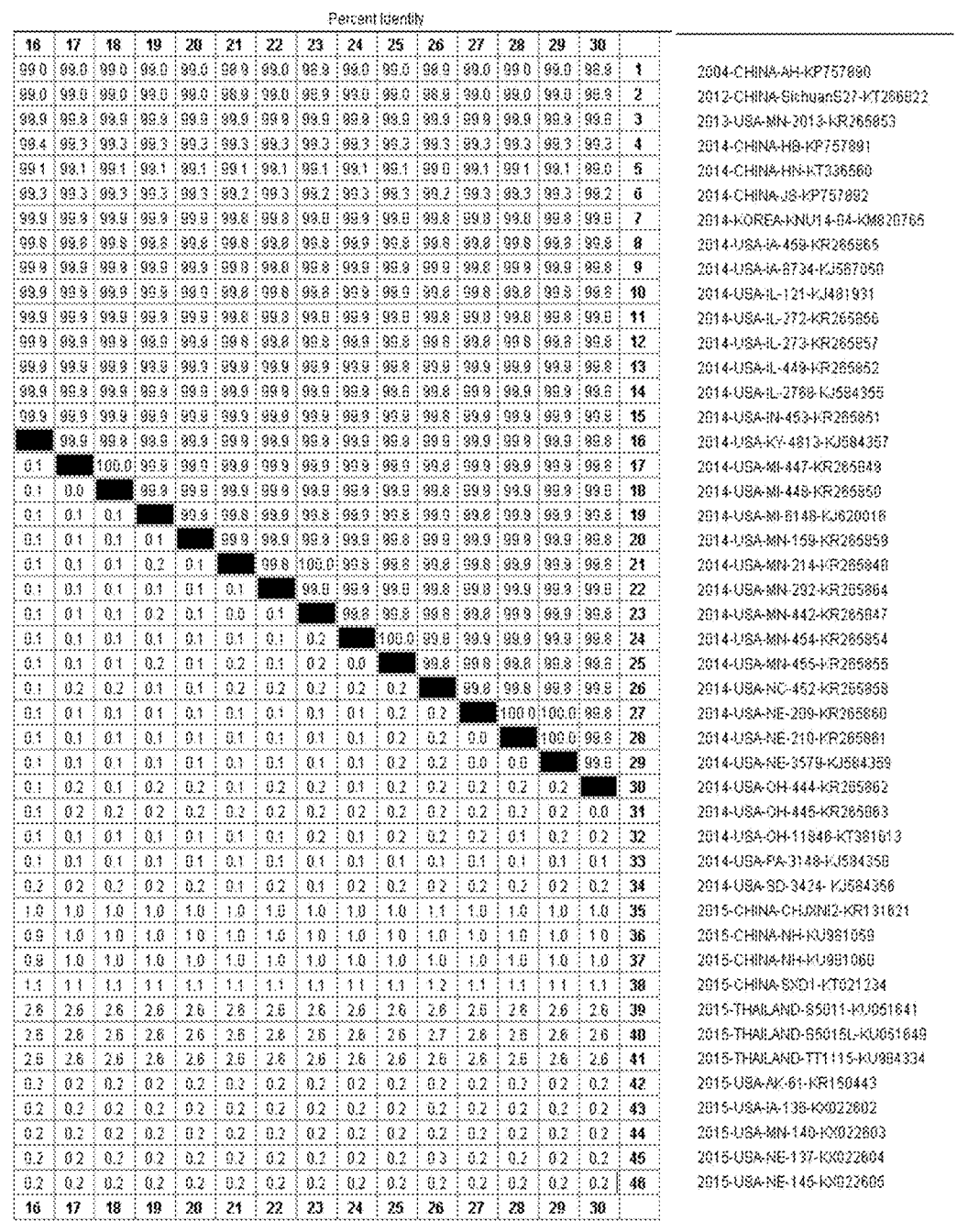
Figure 10C:
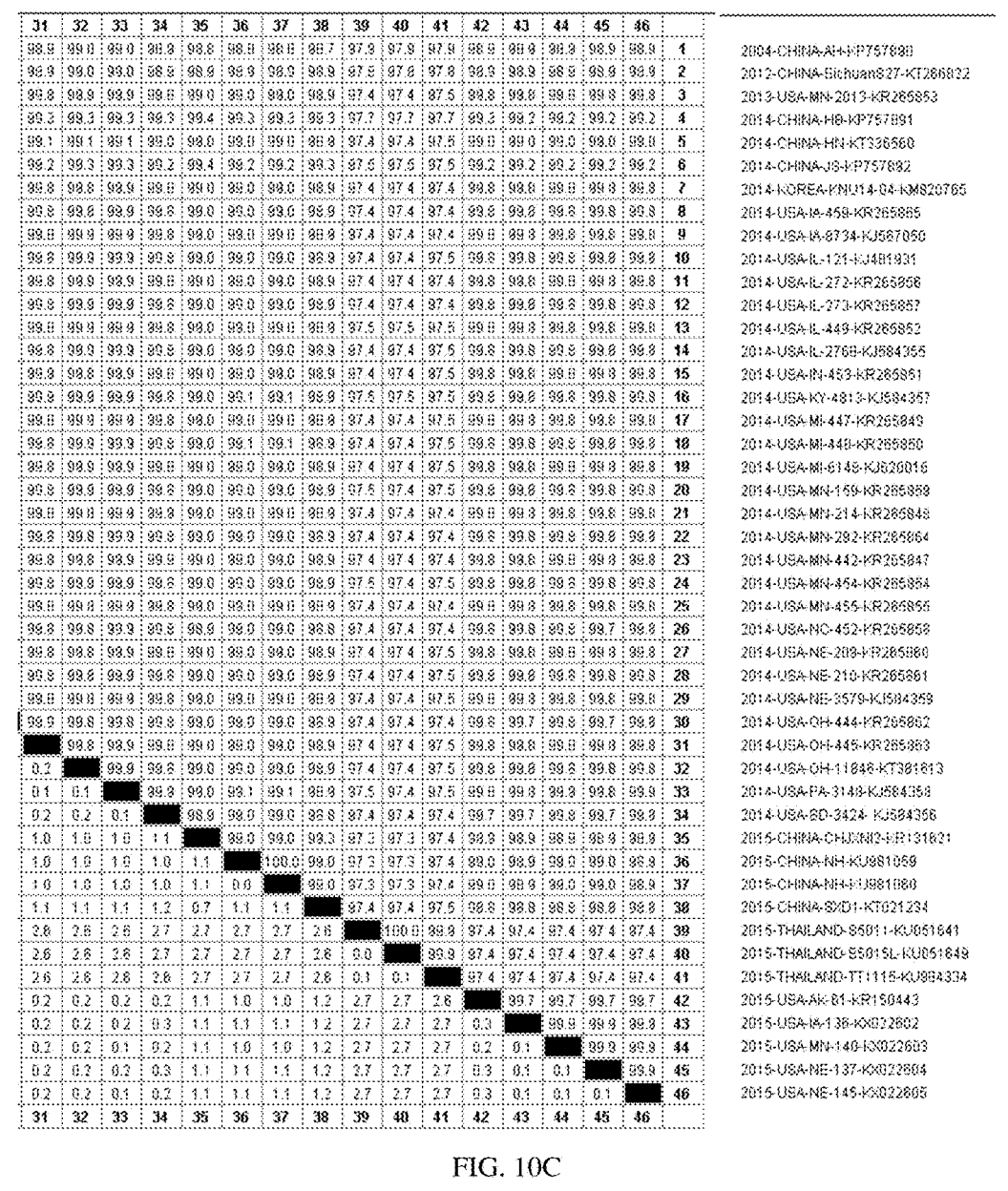
Figure 11:
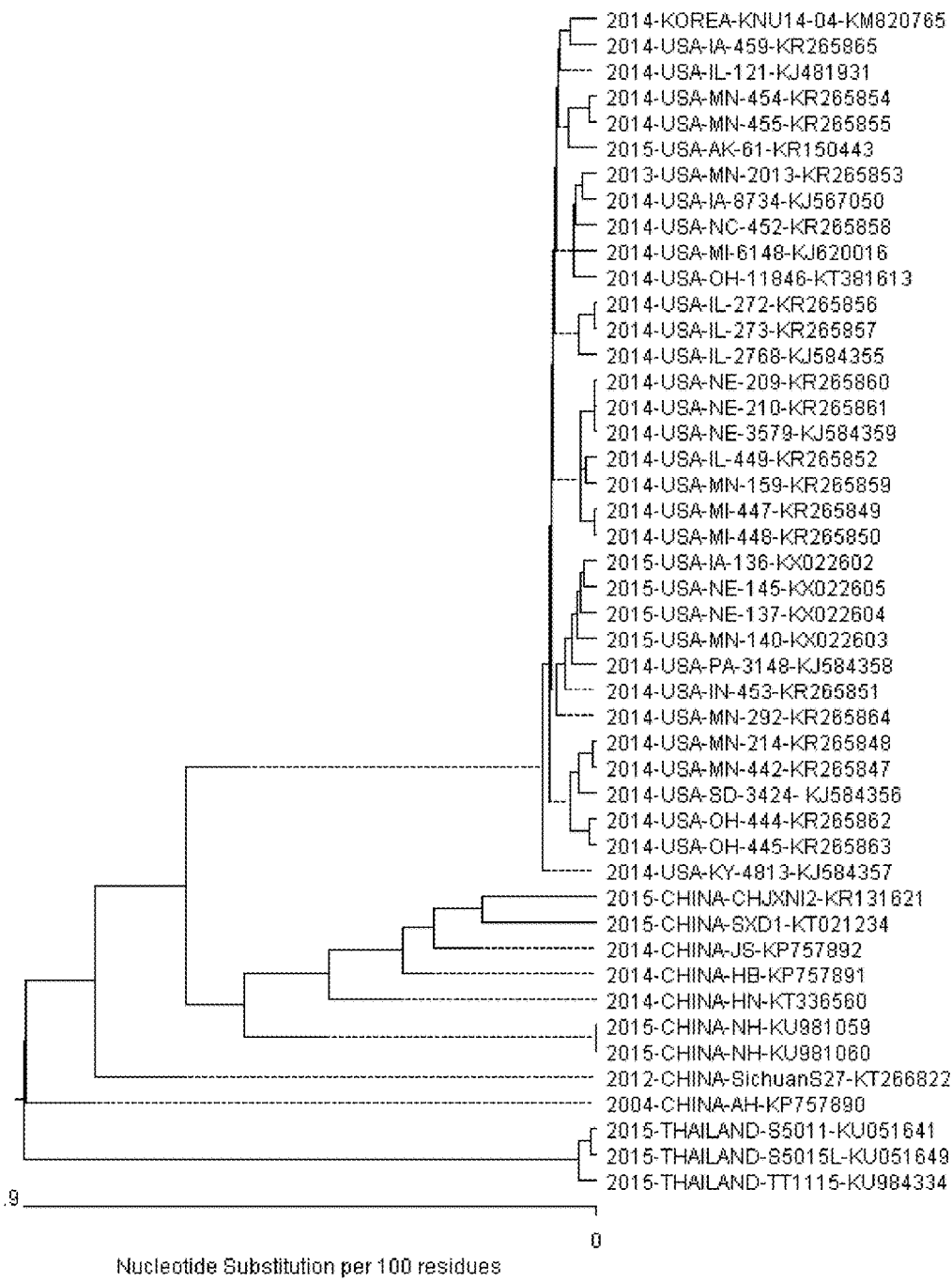
FIG. 11 is a schematic diagram illustrating the relationship between the PDCoV strains or isolates of SEQ ID NOS: 18-63 in terms of nucleotide substitutions per 100 residues.

Porcine deltacoronavirus (PDCoV) was identified in several states across the United Sates in 2014. Symptoms of PDCoV infection include watery diarrhea, vomiting and dehydration. The genomic sequence of PDCoV is about 25-26 kilobases, excluding the 3' poly(A) tail. Typically, PDCoV strains in the U.S. have at least 99% homology with each other, such as at least 99.2%, at least 99.4%, or at least 99.5% homology with other U.S. strains. U.S. strains also have at least 85% homology with Chinese, Korean, and/or Thai strains or isolates, such as at least 90%, at least 95%, or at least 97% homology. FIGS. 10A-10C shows a comparison of the homologies of 46 strains or isolates from Korea (SEQ ID NO: 18), North America (SEQ ID NOS: 19-51), China (SEQ ID NOS: 52-60) and Thailand (SEQ ID NOS: 61-63). And FIG. 11 shows the relationship between the strains or isolates of SEQ ID NOS: 18-63 in terms of nucleotide substitutions per 100 residues.

Disclosed herein are embodiments of a method for making a coronavirus immunogenic composition, such as a PEDV or PDCoV immunogenic composition, comprising incubating coronavirus infected cells for an effective period of time to result in one or more replicated coronavirus viral particles being released, such as from 24 to 60 hours or from 24 to 48 hours, isolating cells infected with coronavirus away from cell-free coronavirus virus particles to form cells containing cell-associated coronavirus proteins and antigens, separating the coronavirus proteins and antigens from the isolated cells to form a first solution comprising isolated coronavirus proteins and antigens, and optionally inactivating viral particles in the first solution to produce a second solution. Any embodiments of the method may further comprise adding an adjuvant to the second solution. The adjuvant may be any adjuvant suitable for use with the coronavirus proteins and antigens. The adjuvant may be selected to stimulate a mucosal antibody response and/or may be selected for intranasal administration and/or intravaginal administration. The adjuvant may adhere to the mucous membranes, and/or comprise polyacrylic acid. In any of the disclosed embodiments, the immunogenic composition may be a vaccine and/or may be formulated for intranasal administration. Any embodiments of the method may comprise extracting coronavirus proteins and antigens, eluting coronavirus proteins and antigens, a freeze-thaw cycle, or a combination thereof. In particular embodiments, the coronavirus is PEDV, or PDCoV.

Also disclosed are embodiments of an immunogenic composition comprising a first antigenic component comprising isolated coronavirus proteins and/or antigens from a first coronavirus strain. The immunogenic composition may comprise an amount of S protein, such as an amount sufficient to produce an immune response in a subject receiving the immunogenic composition. The S protein may be an intact S protein. In any of the above embodiments, the immunogenic composition may comprise a second antigenic component. The second antigenic component may comprise isolated coronavirus proteins and/or antigens from a second coronavirus species and/or strain or isolated proteins and/or antigens from a second pathogen other than a coronavirus. In some embodiments, second pathogen is porcine reproductive and respiratory syndrome virus, and in other embodiments, the second pathogen is *Mycoplasma hyopneumoniae*. However, in certain embodiments when the coronavirus is or comprises PEDV, the second pathogen is not *Mycoplasma hyopneumoniae*.

In any of the above embodiments, the immunogenic composition may be a vaccine and/or may comprise an adjuvant selected to stimulate an antibody response. The adjuvant may be selected to stimulate a mucosal antibody response and/or adhere to the mucous membranes. The adjuvant may comprise a polyacrylic acid adjuvant and/or an emulsified oil-in-water adjuvant. The adjuvant may comprise an ammonium salt, such as a tetraalkylammonium salt, and in certain embodiments, the adjuvant comprises dimethyldioctadecylammonium bromide.

Also disclosed are embodiments of a method of administering to a subject an effective amount of any embodiment of the immunogenic composition disclosed herein. In some embodiments, the subject is less than 7 days old, such as 5 days old or less, or 2 days old or less. In any of the above embodiments, administering may comprise administering orally, intramuscularly, or subcutaneously, or it may comprise administering intranasally. In particular embodiments, the subject is a swine.

In any of the above embodiments where the subject is a swine, the method may comprise administering a first immunogenic composition to a sow, and administering a second immunogenic composition to at least one piglet farrowed from the sow, the second immunogenic composition, and optionally the first immunogenic composition, independently being any embodiment of the immunogenic composition disclosed herein. In any embodiments, the second immunogenic composition may be administered intranasally and/or the first immunogenic composition may be administered intramuscularly.

In any of the above embodiments, the subject may be a pregnant sow, or a sow expected to become pregnant subsequent to administration of the first immunogenic composition. The first immunogenic composition may be administered at a time point prior to the sow becoming pregnant such that, when pregnant, the sow has a greater immunity to PEDV compared to a pig not administered the immunogenic composition.

Further disclosed are embodiments of a use of any embodiments of the immunogenic composition disclosed herein in the manufacture of a medicament for administration to a subject, such as a pig.

III. Method of Extracting or Eluting Coronavirus Proteins and/or Antigens

The disclosure is based in part on the availability and knowledge of cell culture techniques and their use in the propagation of viruses, such as coronaviruses including, but not limited to, PEDV and PDCoV. MJ Biologics, Inc., is also the assignee of U.S. Pat. Nos. 7,241,582, 7,449,296, 7,776, 537 and 8,142,788, all incorporated herein in their entirety by reference, which provide additional information relating to cell culture techniques and their use in the propagation of the porcine reproductive and respiratory syndrome virus (PRRSV). The disclosure may be practiced by use of any suitable cell line susceptible to coronavirus infection and intracellular replication in vitro. Thus the infected cell may be any that is capable of being productively infected by the coronavirus. Non-limiting examples include mammalian cell, such as porcine cells, either in vitro or in vivo. One non-limiting example of cells in vitro is primary cells from a porcine subject that is infected with a coronavirus, such as PEDV or PDCoV. Other non-limiting examples include simian cell lines, such as MA-104; VERO cells; BGM cells; MDCK cells and ST cells. In certain embodiments, MARC cells are used.

With respect to PEDV, the disclosure may be practiced by use of any suitable cell line susceptible to PEDV infection and intracellular replication in vitro, such as PEDV having at least a 90% sequence identity (i.e., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, or SEQ ID NO: 9. In certain embodiments, the PEDV has at least 90% sequence identity (i.e., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to SEQ ID NO: 1, SEQ ID NO: 2, SEQ ID NO: 3, SEQ ID NO: 4, SEQ ID NO: 5, or SEQ ID NO: 6. Thus the infected cell may be any that is capable of being productively infected by PEDV. Non-limiting examples include porcine cells, either in vitro or in vivo. One non-limiting example of cells in vitro is primary cells from a porcine subject that is infected with PEDV. Other non-limiting examples are with the use of a simian cell line, such as MA-104; VERO cells; BGM cells; MDCK cells; MARC cells, and ST cells.

With respect to PDCoV, the disclosure may be practiced by use of any suitable cell line susceptible to PDCoV infection and intracellular replication in vitro, such as PDCoV having at least a 90% sequence identity (i.e., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to one or more of SEQ ID NOS: 18-63. In certain embodiments, the PDCoV has at least 90% sequence identity (i.e., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to one or more of SEQ ID NOS: 19-51. Thus the infected cell may be any that is capable of being productively infected by PDCoV. Non-limiting examples include porcine cells, either in vitro or in vivo. One non-limiting example of cells in vitro is primary cells from a porcine subject that is infected with PDCoV. Other non-limiting examples are with the use of a simian cell line, such as MA-104; VERO cells; BGM cells; MDCK cells; MARC cells, and ST cells.

Infection of cells with the coronavirus, such as PEDV or PDCoV, may be at any suitable multiplicity of infection (m.o.i.), such as 0.1, 0.5 or 1, and infection of all cells in a culture is not required. In some cases, initial infection of some cells in a culture may be followed by subsequent release of infectious coronavirus that infects non-infected cells in the culture. The infected cells may still be used in the practice of the disclosed methods.

After contact and infection with the coronavirus, the virus is allowed to intracellularly reproduce its proteins and antigens, and so replicate, for a suitable period of time. The suitable period of time may vary between different coronaviruses, isolates, strains, and/or subtypes. In some embodiments, post-infection times range from 1 hour to at least 3 days, such as from 6 hours to 3 days, from 12 hours to 60 hours, or from 24 hours to 48 hours. Other post-infection times include about 12 hours, about 18 hours, about 24 hours, about 30 hours, about 36 hours, about 42 hours, about 48 hours, about 54 hours, about 60 hours, and about 66 hours. Coronavirus culture, such as PEDV or PDCoV culture, typically does not go for more than four days, and thus the harvest may be a late term harvest, such as after 24 hours. This is in contrast to PRRSV, where the proteins and antigens are typically harvested at an early term harvest at 28-60 hours post infection. A person of ordinary skill in the art will understand that 'early term' and 'late term' are virus dependent. For example a PRRSV culture will typically take 5 days to finish, whereas a coronavirus culture, such as PEDV or PDCoV culture, will typically finish after 3 days.

A method of assessing coronavirus protein production over time, after infection, also is disclosed to determine possible time points for isolation of infected cells and collection of viral proteins and/or antigens from the cells. In some embodiments, the method comprises taking samples at different time points after infecting the cells with the virus. The time points may be based on the percentage of cytopathic effect (CPE %), such as 15%, 20%, 25%, 30%, 35%, 40%, 50%, 60%, 70%, 80% and/or 90%. Sampling may comprise separating the supernatant from the cells, such as by pouring. The cells may be in a suitable culture vessel, such as a T25, T75 or roller bottle. After separation, an extraction buffer is added to the vessel containing the cells. Typically, the amount of buffer added is from about one half to about one tenth volume of the supernatant volume, such as from about one quarter to about one eighth, or from about one fifth to about one sixth volume of the supernatant volume. The vessel is agitated, such as by rocking and/or rolling. The agitation is performed for a time period and at a temperature sufficient to facilitate extraction of the proteins and antigens. The time period may be from greater than 0 to at least 60 minutes, such as from 1 minute to 30 minutes, or from 5 minutes to 20 minutes. The temperature may be any temperature suitable to facilitate the extraction, such as from greater than zero to at least 50° C., from 10° C. to 40° C., from 20° C. to 30° C., or about 25° C. The temperature may be an ambient temperature. The extraction buffer is then separated and the extracts analyzed by a suitable technique, such as Western blot, to provide data concerning the presence and/or amount of target antigen versus time. An optimal harvest time is selected based on the data. Typically, the optimal harvest time provides the culture time, or range of culture times, that provide a desired CPE % and/or desired target antigen content.

This "time course" assessment after infection may be used to select a post infection time point for the preparation of viral proteins and/or antigens. The assessment is optionally performed for each coronavirus isolate, strain, and/or subtype. The protein and/or antigen yields may also be compared using different coronavirus isolates and different days after virus inoculation, and optimal conditions for the highest antigenic yields may be determined by comparative testing.

Coronaviruses produces several proteins, including spike protein. With respect to PEDV, the spike protein has a molecular weight of about 152 kDa based on deduced amino acid sequences. After post-translational modifications the protein may have a molecular weight of from 180 kDa to at least 350 kDa, depending, for example, on the amount of post-translational glycosylation. The molecular weight may be determined by any suitable technique, such as, for example Western blot. PEDV spike protein has been predicted to comprise two portions—S1 at the N-terminus and S2 at the C-terminus. The spike protein may be a spike protein encoded by a PEDV having least 90% sequence identity (i.e., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, or SEQ ID NO: 9. In certain embodiments, the spike protein is encoded by a PEDV having least 90% identity (i.e., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to SEQ ID NO: 1, SEQ ID NO: 2, SEQ ID NO: 3, SEQ ID NO: 4, SEQ ID NO: 5, or SEQ ID NO: 6. The spike protein may have a sequence with at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, sequence identity to SEQ ID NO: 10, SEQ ID NO: 11, SEQ ID NO: 12, SEQ ID NO: 13, SEQ ID NO: 14, SEQ ID NO: 15, SEQ ID NO: 16, or SEQ ID NO: 17. In certain embodiments, the spike protein may have a sequence with at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, sequence identity to SEQ ID NO: 10, SEQ ID NO: 11, SEQ ID NO: 12, SEQ ID NO: 13, SEQ ID NO: 14, or SEQ ID NO: 15. An indication that two peptide sequences are substantially identical is that one peptide is immunologically reactive with antibodies raised against the second peptide. Thus, a peptide is substantially identical to a second peptide, for example, where the two peptides differ only by a conservative substitution.

Without being bound to a particular theory, the coronavirus proteins and antigens, such as PEDV and PDCoV proteins and antigens, produced by the disclosed method include spike proteins in multiple glycosylation states. This is due, in part, to breaking open the infected cells to separate and release the proteins and antigens substantially before viral particles are released into the culture medium. As a result, spike protein glycosylation is in progress, rather than being substantially completed, and therefore, the separated spike proteins have a range of molecular weights. By administering to a subject an immunogenic composition comprising such spike proteins, the subject is exposed to spike proteins having different glycosylation states, and thus produces antibodies to these proteins. This may be advantageous for the subject, compared to a subject that is administered either a composition that only includes non-glycosylated spike protein, such as a recombinant protein generally from prokaryote, or a composition that has substantially only fully glycosylated spike protein, such as a conventional killed vaccine that is typically made with fully grown virus culture material.

In some embodiments, post-infection times are selected to provide an amount of the spike protein in the composition, such as an extract or eluant, sufficient to provide an immune response, such as a protective immune response, in a subject.

In certain embodiments, the post-infection time is selected such that coronavirus viral particles are present in the culture medium prior to the collecting, extracting and/or eluting process. In some embodiments, the proteins and/or antigens, such as the spike protein, harvested from coronavirus infected cells, such as PEDV or PDCoV infected cells, may be in greater amounts than those available from coronavirus particles in the culture medium, such as at least 2×, 3×, 4×, 5× or more than 5× the amount available from coronavirus particles in the culture medium.

In some embodiments, the proteins and/or antigens harvested from coronavirus infected cells may be in greater amounts than those available from coronavirus particles in the culture medium. At some time points after infection, the majority, or entirety, of the replicated coronavirus proteins may remain associated with the infected cells or are otherwise part of a cell associated viral component (CAVC). Thus the majority or entirety of coronavirus proteins and/or antigens are either within the infected cells or associated with the cell membrane of the infected cells. Under such conditions, relatively few, if any, coronavirus particles are present in the extracellular environment. The preparation of CAVC from an early time point, such as before the production of coronavirus particles and/or the release thereof into the extracellular environment also has the benefit of increased safety in that few, if any, infectious viral particles are present as a contaminant. In some embodiments, no infectious viral particles are present as a contaminant.

However, in other embodiments, it was surprisingly found that harvesting the proteins and antigens at a time point after the infected cells had released replicated coronavirus viral particles, such as PEDv or PDCoV viral particles, resulted in improved results. This was in contrast to results obtained with certain other viruses, such as PRRSV, as disclosed in U.S. Pat. Nos. 7,241,582, 7,449,296, 7,776,537, and 8,142,788.

In some embodiments, the method of preparing coronavirus proteins and antigens from coronavirus infected cells comprises providing a population of cells infected with coronavirus; isolating the infected cells away from cell-free coronavirus to form cells containing cell-associated coronavirus proteins and antigens; and extracting or eluting coronavirus proteins and antigens from the isolated cells. In some disclosed embodiments, the coronavirus is PEDV. In other embodiments, the coronavirus is PDCoV. The composition may be a solution. The coronavirus may comprise one or more species and/or one or more strains of coronavirus, such as two or more species and/or strains having at least one nucleotide difference between their genomes.

As used herein, the terms "separating" and "separation" refer to, by way of unlimited examples, breaking open, extracting, eluting, rupturing, lysing, centrifuging, filtering, or a combination thereof, to release the proteins and antigens from within the isolated cells. The composition may also comprise cell fragments. In cases wherein there is no cell-free virus present, then isolating the infected cells away from cell-free coronavirus may comprise isolating the infected cells from other materials that may interfere with the method, such as the culture medium used with the cells. The isolation step may be performed by any means known in the art, such as by simply pouring off the medium and leaving the cells to be extracted by detergents or freeze/thaw, or use of centrifugation to generate a cell pellet and supernatant. The supernatant can then be removed and/or discarded, such as by use of a membrane filtration, to leave the cells. The separation of viral proteins and antigens may be performed by any suitable method, such as extraction, elution and/or freeze-thawing. The extraction step is optionally performed by re-suspending the cells in a buffer. In some embodiments, the isolation step may be performed by simply pouring off the medium and leaving the cells on culture devises such as flasks, roller bottles or cell culture carriers to be extracted by detergents or freeze/thawing with buffer. The extraction or elution is performed with a detergent-containing solution, thus the buffer used to re-suspend cells may contain detergent. In other embodiments, the extraction may be performed by freeze-thaw method. Optionally, the viral proteins and/or antigens produced by the method include coronavirus envelope proteins.

In some embodiments, the method comprises using a population of cells that has been infected with coronavirus for a sufficient time to produce little to undetectable amounts of infectious units per ml of supernatant, such as the culture media used with the cells. In some embodiments, the time is sufficient to produce tissue culture infective doses/ml ($TCID_{50}$/ml) of from $10^1$ to $10^{10}$, such as from $10^1$ to $10^7$, or from $10^1$ to $10^{5.5}$. Non-limiting examples include using less than $10^{5.5}$, such as $10^4$ or less, or $10^3$ or less $TCID_{50}$/ml.

The detergent-containing solution may be any that is suitable for extracting or eluting coronavirus proteins and/or antigens. One non-limiting example of a suitable class of detergents is non-ionic detergents. Particular exemplary detergents include, but are not limited to poly(ethylene glycol) p-isooctyl-phenyl ether, octylphenoxypolyethoxyethanol (Nonidet P-40), or 4-(1,1,3,3-tetramethylbutyl)phenyl-polyethylene glycol (Triton X-100). The detergent is used at a concentration effective for extracting or eluting coronavirus proteins and/or antigens, such as a concentration of from greater than zero to 5% in solution, such as from greater than zero to 2%, 0.25% to 1%, or 0.5% in solution. In certain embodiments, the detergent is a solution of 0.5% Triton X-100. The collecting, extracting and/or eluting may be for from greater than zero to at least about 24 hours, such as from 0.1 hours to 24 hours, 0.1 hours to 15 hours, 0.2 hours to 10 hours or 0.2 hours to 5 hours, or in certain embodiments from 2 hours to 15 hours. The collecting, extracting and/or, eluting is performed at a suitable temperature. In some embodiments, the temperature is from zero to less than 30° C., such as from 0° C. to 25° C., from 1° C. to 20° C., from 2° C. to 10° C. or from 2° C. to 6° C., and in certain embodiments is 4° C., or room temperature, such as from 20 to 25° C. Optionally, the viral proteins and/or antigens produced by the method include coronavirus envelope proteins.

For a freeze-thaw process a buffer may be added to the cells, typically after the culture medium is removed. The buffer can be any suitable buffer, such as Tris or phosphate buffered saline (PBS) with or without chelating agents, such as EDTA as non-limiting example. The cells are coated with the buffer, such as by agitation, for example, swirling or stirring. The cells are then placed in a freezer at a temperature suitable to freeze the cells and buffer, such as −10° C. or below. After the cells are frozen, they are allowed to thaw. The thawing causes cells to break, thereby releasing the proteins and antigens. Additional freeze-thaw cycles may be performed to release additional proteins and antigens.

After the release of the proteins and antigens, an inactivating agent may be added. Suitable inactivating agents include any agent that will inactivate viral particles present in the solution of viral protein and antigens, such as binary ethyleneimine (BEI), formalin, or beta propiolactone (BPL). The concentration of activating agent may be from 0.01 mol/L to at least 2 mol/L, such as from 0.01 mol/L to 1 mol/L. The solution of viral protein and antigens is mixed with the inactivating agent until inactivation is complete, such as for from 5 minutes to 48 hours or more, such as 15 minutes to 2 hours, or from 30 minutes to 1 hour. The inactivation process can be stopped by the addition of a sufficient amount of thiosulfate solution, such as sodium thiosulfate, to neutralize the excess inactivating agent. After inactivation, the solution of viral protein and antigens may be optionally diluted before a suitable adjuvant is added to the solution to produce the immunogenic composition.

The immunogenic composition will contain an effective amount of coronavirus antigens, such as PEDV or PDCoV antigens, in the solution, the effective amount being readily determined by a person of ordinary skill in the art. The effective amount may be sufficient to produce a desired immune response in a subject, such as a substantially protective immune response. The amount of coronavirus antigens may typically range from about 1% to about 95% (w/w) of the composition, or even higher or lower if appropriate. The quantity to be administered depends upon factors such as the age, weight and physical condition of the individual considered for vaccination. The quantity also depends upon the capacity of the subject's immune system to synthesize antibodies, and the degree of protection desired. Effective dosages can be readily established by a person of ordinary skill in the art through routine trials establishing dose response curves. In some embodiments, the concentration of viral antigens in the solution of coronavirus protein and antigens is from 0.01 ng/ml to 10,000 ng/ml, such as from 0.1 ng/ml to 5,000 ng/ml, from 0.5 ng/ml to 1,000 ng/ml or from 1 ng/ml to 100 ng/ml. The volume of the dosage is from greater than 0 mL to at least 10 mL, such as from 0.1 mL to 10 mL, from 0.5 mL to 5 mL, or from 0.5 mL to 2 mL.

The coronavirus proteins and antigens may be prepared from coronavirus infected cells. In certain embodiments, the method comprises preparing the proteins and antigens from a population of the cells prepared by in vitro and in vivo methods. For the in vitro method, VERO cells are cultured, and the cells are harvested following an infection of coronavirus.

IV. Compositions and Applications

Disclosed herein are embodiments of a composition comprising the isolated coronavirus proteins and/or antigens prepared according to embodiments of the disclosed method. While a person of ordinary skill in the art will appreciate that certain disclosed embodiments of the method concern isolating proteins and/or antigens from cells and/or culture media, the proteins and/or antigens are not necessarily purified. Thus, the composition may further comprise cell fragments, the extracting detergent, virus-infected cell lysate, or a combination thereof. The composition is suitable for use for any purpose for which coronavirus proteins and/or antigens are used. Non-limiting examples of applications of the proteins and/or antigens include the preparation of antibodies against the proteins/antigens; using the proteins and/or antigens as reference markers for coronavirus proteins; and using the proteins and/or antigens in an immunogenic composition, such as in a vaccine formulation, typically with a suitable adjuvant and optionally with a suitable carrier, and/or excipient. The immunogenic composition may be administered to a subject, such as an animal, particularly a porcine anime, to generate an immune response. Additional non-limiting examples of the compositions include those where the protein(s)/antigen(s) is/are in soluble or lyophilized (freeze dried) form.

The disclosed immunogenic composition has a different composition to that of a conventional coronavirus vaccine, including a conventional PEDV or PDCoV vaccine, such as a killed or attenuated vaccine. Embodiments of the disclosed method isolate infected cells containing the coronavirus proteins and antigens away from the supernatant, which contains the culture medium, at a time point substantially before viral particles have been released into the culture medium. Any viral particle that have been released into the culture medium are removed with the supernatant. The coronavirus proteins and antigens are then released from the infected cells by a suitable separation technique, such as extracting and/or eluting, freeze/thawing, or other techniques. In some embodiments, the infected cells may be lysed to release the coronavirus proteins and antigens. Any viral particles also released from the infected cells are inactivated, such as by a detergent and/or other inactivating agent. In some embodiments, the detergent is a detergent that is also used to extract and/or elute the proteins and antigens from the infected cells. In other embodiments, the inactivating agent is affirmatively added to the proteins and antigens. Thus, the composition made by the method comprises a high concentration of proteins produced by the infected cells and/or by the virus while within an infected cell, but a low concentration of actual viral particles.

This is in contrast to a killed vaccine, which typically is prepared by allowing the virus to carry the cell infection through the cytopathic effect (CPE) to substantial release of viral particles. Without being bound to a particular theory, the proteins produced by the infected cells and/or by the virus while within an infected cell may be useful for production of the viral particles, but are not necessarily properly exposed to the animal's immune system.

Therefore, the composition and concentration of the proteins and antigens included in the present immunogenic composition is very different from those found in killed or attenuated coronavirus vaccines.

In some embodiments, the immunogenic composition comprises, consists essentially of, or consists of, coronavirus proteins and antigens prepared by the disclosed method, a buffer solution, an adjuvant, an inactivating agent and a neutralizing agent. In certain embodiments, the buffer is PBS with EDTA, the inactivating agent is BEI, and/or the neutralizing agent comprises thiosulfate, such as sodium thiosulfate. In particular embodiments, the adjuvant is an oil-in-water adjuvant, such as an EMULSIGEN®-based adjuvant, or an adjuvant that adheres to the mucosal membranes, such as an adjuvant comprising polyacrylic acid, typically an adjuvant comprising carbopol such as CARBIGEN™.

In some embodiments, the composition comprises PEDV proteins and/or antigens, and may comprise proteins and/or antigens from one or more strains of PEDV, such as from 1, 2, 3, 4, 5, 6, or more strains of PEDV. In some embodiments, the composition comprises PDCoV proteins and/or antigens, and may comprise proteins and/or antigens from one or more strains of PDCoV, such as from 2, 3, 4, 5, 6, or more strains of PDCoV. The composition may comprise proteins and/or antigens from one or more species of coronavirus, such as from 1, 2, 3, 4, 5, 6, or more species of coronavirus, and each species of coronavirus in the composition independently may comprise 1, 2, 3, 4, 5, 6 or more strains of that particular species.

In certain embodiments concerning PEDV, strains suitable for use in the composition include any strain of PED virus, such as strains from North America, Europe and Asia. In particular embodiments, the PEDV strain is a Genogroup 2 strain, and may be a North American strain. In some embodiments, the disclosed immunogenic composition comprises PEDV proteins and antigens encoded by a PEDV strain having at least 90% identity (i.e., 90%, 91%, 92%, 93%, or 94%, or 95%, 96%, 97%, 98%, 99%, 99.1%, 99.2%, 99.3%, 99.4%, 99.5%, 99.6%, 99.7%, 99.8%, 99.9%, or 100%) to SEQ ID NO: 1, SEQ ID NO: 2, SEQ ID NO: 3, SEQ ID NO: 4, SEQ ID NO: 5, or SEQ ID NO: 6. In certain embodiments, the PEDV has at least 99%, 99.9% or 99.99% identity to SEQ ID NO: 1, SEQ ID NO: 2, SEQ ID NO: 3, SEQ ID NO: 4, SEQ ID NO: 5, SEQ ID NO: 6. Exemplary strains include, but are not limited to, the original US PEDV strain, Colorado 2013 (SEQ ID NO: 1), Iowa/18984/2013 (SEQ ID NO: 2), North Carolina USA/NC/2013/35140 (SEQ ID NO: 3), Indiana12.83/2013 (SEQ ID NO: 4), Iowa/2013 (SEQ ID NO: 5), 1251-125-10 (SEQ ID NO: 6), SM98 (SEQ ID NO: 7), KR-DR13-att (SEQ ID NO: 8), the INDEL strain, the S2aa-del strain, CV777, Chinese PEDV strains such as Chinese CH/ZMDZY/11, and AH2012 (SEQ ID NO: 9).

In certain embodiments concerning PDCoV, strains suitable for use in the composition include any strain of PDCoV virus, such as strains from North America, Europe and Asia. In particular embodiments, the PDCoV strain is a North American, Chinese, Korean or Thai strain. In some embodiments, the disclosed immunogenic composition comprises PDCoV proteins and antigens encoded by a PDCoV strain having at least 90% identity (i.e., 90%, 91%, 92%, 93%, or 94%, or 95%, 96%, 97%, 98%, 99%, 99.1%, 99.2%, 99.3%, 99.4%, 99.5%, 99.6%, 99.7%, 99.8%, 99.9%, or 100%) to at least one of SEQ ID NOS: 18-63. In certain embodiments, the PDCoV has at least 99%, 99.9% or 99.99% identity to at least one of SEQ ID NOS: 19-51.

The composition may comprise proteins and/or antigens from at least one additional pathogen. The additional pathogen may be any pathogen that causes illness and/or an infection in a porcine subject. Exemplary pathogens include, but are not limited to, porcine reproductive and respiratory syndrome virus (PRRSV), *Mycoplasma hyopneumoniae, Mycoplasma hyosynoviae, Mycoplasma rhinitis, Clostridium tetani, Clostridium perfringens*, porcine parvovirus, *Erysipelothrix rhusiopathiae, Leptospira pomona, Leptospira grippotyphosa, Leptospira hardjo, Leptospira canicola, Leptospira icterohaemorrhagiae, Leptospira bratislava*, porcine circovirus, *Lawsonia intracellularis, Escherchia coli, Actinobacillus pleuropneumoniae, Haemophilus parasuis, Salmonella choleraesuis, Salmonella typhimurium, Streptococcus suis, Pasteurella multocida, Bordetella bronchiseptica, Actinobacillus pleuropneumoniae, Serpulina hyodysenteriae*, encephalomyocarditis virus, swine influenza virus, transmissible gastroenteritis virus (TGE), swine delta coronavirus, rotavirus diarrhea, foot and mouth disease virus, classical swine fever virus, pseudorabies virus, Japanese encephalitis virus (JEV), encephalomyocarditis virus, or a combination thereof. In certain embodiments, the additional pathogen is not *Mycoplasma hyopneumoniae*. In other embodiments, the additional pathogen is *Clostridium tetani, Clostridium perfringens*, porcine parvovirus, *Erysipelothrix rhusiopathiae, Leptospira pomona, Leptospira grippotyphosa, Leptospira hardjo, Leptospira canicola, Leptospira icterohaemorrhagiae, Leptospira bratislava*, porcine circovirus, *Lawsonia intracellularis, Escherchia coli, Actinobacillus pleuropneumoniae, Haemophilus parasuis, Salmonella choleraesuis, Salmonella typhimurium, Streptococcus suis, Pasteurella multocida, Bordetella bronchiseptica, Actinobacillus pleuropneumoniae, Serpulina hyodysenteriae*, encephalomyocarditis virus, swine influenza virus, transmissible gastroenteritis virus (TGE), rotavirus diarrhea, foot and mouth disease virus, classical swine fever virus, pseudorabies virus, Japanese encephalitis virus (JEV), encephalomyocarditis virus, or a combination thereof.

In particular embodiments, the second pathogen is, or comprises, PRRSV. The PRRSV may comprise one or more North American strains, one or more European strains or combinations thereof. PRRSV strains may include, but are not limited to, Lelystad, VR2332 or HP-PRRSV. In certain embodiments, the PRRSV proteins and/or antigens are extracted or eluted by a method according to one or more of U.S. Pat. Nos. 7,241,582, 7,449,296, 7,776,537 or 8,142,788.

In some embodiments, an immunogenic composition as disclosed herein may comprise coronavirus proteins and/or antigens from one or more coronavirus species and/or strains, and proteins and/or antigens from one or more additional pathogens. In certain embodiments, the additional pathogen comprises PRRSV.

Also disclosed herein are combinations of immunogenic compositions, comprising at least one coronavirus immunogenic composition and at least one immunogenic composition directed toward a non-coronavirus porcine pathogen. In certain embodiments, the additional pathogen is or comprises PRRSV. In particular embodiments, the PRRSV immunogenic composition is an immunogenic composition prepared according to the methods disclosed in one or more of U.S. Pat. Nos. 7,241,582, 7,449,296, 7,776,537 or 8,142,788.

The immunogenic compositions in the combination of immunogenic compositions may be administered sequentially in any order, or at substantially the same time. In some embodiments, the immunogenic compositions may be mixed to form a single administrable composition. In other embodiments, the immunogenic compositions are administered as separate formulations.

The immunogenic compositions disclosed herein may also be administered in combination with other therapeutic agents suitable for administration to the subject, such as antibiotics, antiviral agents, antifungal agents, antiparasitic agents, or combinations thereof.

V. Detection of Protective Antibodies Against PEDV

Disclosed herein are embodiments of a method of detecting protective antibodies against PEDV. Antibodies against PEDV spike proteins having a molecular weight between 180-kDa to 350-kDa provide immunological protection in livestock such as swine. Accordingly, certain disclosed embodiments provide an agent that binds the antibodies against 180-kDa to 350-kDa of porcine epidemic diarrhea virus (PEDV), or PEDV. The agent may be used in embodiments of a method, device, and/or kit for detecting the presence of the antibodies against 180-kDa to 350-kDa of PEDV spike protein in a biological fluid.

Thus, disclosed herein are embodiments of a method of detecting antibodies against 180-kDa to 350-kDa post translationally modified PEDV spike protein in a sample of a biological fluid from a subject, particularly but not necessarily a porcine subject, suspected of being infected with PEDV. The method comprises contacting the sample, or a diluted form thereof, with a binding agent that binds the antibodies against 180-kDa to 350-kDa of PEDV spike protein. The binding of the agent, or agents, to the antibodies against 180-kDa to 350-kDa of PEDV spike protein forms a complex that may be detected to indicate the presence of the antibodies against 180-kDa to 350-kDa of PEDV spike protein post translational variants, and thus the presence of a PEDV infection in the subject from which the sample was obtained.

The biological fluid may be any fluid in which antibodies against 180-kDa to 350-kDa of PEDV spike protein post translational variants may be present in detectable amounts. Non-limiting examples include bodily secretions, such as saliva, tears, mucous, nasal discharge, and vaginal secretions as well as other bodily fluids such as blood, serum, plasma, semen, seminal fluid, milk, and urine as well as any fluid component of feces or a fluid extract of feces.

The binding agent which binds the antibodies against 180-kDa to 350-kDa of PEDV spike protein may be the spike protein, a 180-kDa to 350-kDa of PEDV spike protein post translational variants, or derivative thereof. In particular, binding agents may also be used to immobilize the antibodies against 180-kDa to 350-kDa of PEDV spike protein, or a macromolecular complex containing it, to facilitate its detection.

Also contemplated are labeled forms of the binding agent to facilitate its detection when bound to antibodies against 180-kDa to 350-kDa of PEDV spike protein. The binding agent may be labeled to permit direct detection, such as by conjugation to a label which is visible to the eye upon sufficient aggregation. Alternatively, the binding agent may be labeled for indirect detection, such as by conjugation to an enzyme, which is detected based upon its activity on a detectable substrate or to produce a detectable product. The binding agent may also be unlabeled and then detected based upon use of a detectable reagent, which binds the binding agent after formation of the complex. As a non-limiting example with the use of an antibody as the binding agent, the antibody complex comprising antibodies against 180-kDa to 350-kDa of PEDV spike protein post translational variants may be detected by a detectably labeled secondary antibody which binds the antibody bound to the antibodies against 180-kDa to 350-kDa of PEDV spike protein.

In another embodiment, detecting the binding agent complex is facilitated by immobilization of the complex. In some embodiments, the complex is immobilized to a solid substrate comprising an immobilized second binding agent which binds and immobilizes the complex. A first non-limiting example of such an embodiment comprises using a second binding agent to localize the complexes in discrete areas of the substrate to improve detection.

In another non-limiting embodiment, immobilization forms a "sandwich" wherein antibodies against 180-kDa to 350-kDa of PEDV spike protein are "sandwiched" between the binding agent and a second agent immobilized on a solid substrate which also binds antibodies against 180-kDa to 350-kDa of PEDV spike protein. As a non-limiting example, the complex may be immobilized by binding to a second binding agent immobilized to a solid substrate, such as a surface of a well, plate, dish or tube. The complex may then by detected based on localization on the surface. Alternatively the solid substrate may be a bead or chromatographic media which permits detection based on localization on the bead or media. The second binding agent preferably binds the antibodies against 180-kDa to 350-kDa of PEDV spike protein and the binding agent as described herein. Alternatively, the second binding agent is the same as the binding agent.

Also disclosed are embodiments of a device for practicing the above described method. Generally, such devices are useful for detecting the presence of antibodies against 180-kDa to 350-kDa of PEDV spike protein in a sample of a biological fluid as an indicator of PEDV infection in the subject from which the sample was taken. Thus the devices may be used as a rapid means of diagnosing the presence of PEDV infection.

The test strip may be uniform in composition, such as by being a unitary membrane strip comprising the first and second portions as described herein. Non-limiting examples include a strip of nitrocellulose membrane of appropriate pore size. Non-limiting examples of pore sizes include those in the range of 1-250 microns. Other non-bibulous materials may also be used, along with one or more mobilization agent as described herein to improve the mobilization of a dried first binding agent (the detector agent or preferably the detector antibody). Non-limiting examples of a mobilization reagent include glazes comprising sugar and/or BSA (bovine serum albumin).

Alternatively, the test strip is non-unitary in construction but the different components are functionally linked to permit fluid communication therebetween. In some embodiments, the first portion of the test strip as defined herein is composed of a porous or bibulous material. Non-limiting examples include cellulose or glass wool.

Placement of the first binding agent in a mobilizable form on the first portion of a device of the invention is preferably by drying a solution containing the agent thereon. In some embodiments, the solution is sprayed on and then dried prior to use. A non-limiting representative example of such a solution is one containing a detector reagent of the invention. Preferably, the first binding agent is labeled as described herein, such as with colloidal gold as a non-limiting example. In other embodiments, the test strip is within a housing or casing comprising liquid impermeable material to facilitate the manipulation and use of the test strip.

The test strip may be designed to operate solely based on the liquid available from a sample applied thereto (see for example U.S. Pat. No. 5,591,645 for analogous test strip embodiments). Alternatively, the test strip may be designed to operate in connection with a solvent or developing solution which increases the volume of the sample applied to the test strip (see for example U.S. Pat. No. 4,235,601 for analogous embodiments). In other embodiments, the test strip is embodied in a housing or casing, preferably composed of a plastic, polyacrylate or other liquid resistant material, to form a device of the invention. The test strip may include a backing composed of similar materials.

A test strip or other device of the invention may also comprise a control site or control region as described herein. The control site or region may comprise a reagent that produces a color upon being wetted. Non-limiting examples include cobalt chloride, copper chloride, and the like. Alternatively, the reagent may be a pH indicator which exhibits a color at the pH of the traversing fluid different from the color in the dry state. In a further alternative, the reagent is one that binds, and thus permits the detection of, a labeled first binding agent regardless of whether it has bound antibodies against 180-kDa to 350-kDa of PEDV spike protein.

The device may comprise both a first binding agent which binds antibodies against 180-kDa to 350-kDa of PEDV spike protein to form a complex and a second binding agent which immobilizes the complex. The first binding agent may thus be viewed as a "detector agent" and is as described herein. Where the first binding agent is 180-kDa to 350-kDa of PEDV spike protein, it may be viewed as a "detector antigen." The first binding agent may be located in a mobilizable form on a first portion of the device. A non-limiting example of how to make such a mobilizable first binding agent comprises drying the agent on a first portion of a device. Upon hydration with a liquid, such as a sample of a biological fluid, the agent is mobilized within the sample and thus may move with the liquid. Where the liquid, such as a sample of a biological fluid, contains antibodies against 200-kDa to 350-kDa of PEDV spike protein, the first binding agent binds the antibodies against 180-kDa to 350-kDa of PEDV spike protein to form a complex which moves with the liquid.

A second binding agent is immobilized on a second portion of a device to bind and immobilize a complex comprising the first binding agent and antibodies against 180-kDa to 350-kDa of PEDV spike protein when such a complex contacts the second binding agent. The second binding agent may thus be viewed as the "capture agent," or in the case of an antigen as the second binding agent, a "capture antigen." Contact between the second binding agent and the complex occurs via the movement of a liquid containing the complex, such as a sample of a biological fluid that contains a complex of antibodies against 180-kDa to 350-kDa of PEDV spike protein and mobilized first binding agent as described above, into contact with the second binding agent. Such movement is readily accomplished by the first and second portions of the device being in fluid communication with each other such that fluid in the first portion will move into and through the second portion. Such fluid communication may be direct, with no intervening material between the first and second portions, or indirect, with an intervening material between the first and second portions that permits liquid to pass from the first to second portions.

Detection of immobilized complex in the device, preferably by detection of a detectably labeled first binding agent immobilized in the second portion as permitted by the device, may be used to indicate the presence of antibodies against 180-kDa to 350-kDa of PEDV spike protein in a sample of biological fluid. The presence of antibodies against 180-kDa to 350-kDa of PEDV spike protein may be used as an indication of PEDV infection in the subject from which the sample was obtained. The sample is preferably from a porcine subject, or other subject suspected of being infected with PEDV, but any subject which may be infected by PEDV carrier may be used in the devices of the invention.

Biological fluids that may be used in the device include any fluid in which antibodies against 180-kDa to 350-kDa of PEDV spike protein may be detectably present. Non-limiting examples have been provided above and below, and dilutions of such fluids may also be used as the sample.

The present disclosure provides a binding agent capable of binding antibodies against 180-kDa to 350-kDa of PEDV spike protein in a sample of a biological fluid from a subject. Preferably, the binding agent specifically binds 180-kDa to 350-kDa of PEDV spike protein antibodies to the exclusion of other molecules present in the biological fluid. In many embodiments of the disclosure, the subject is a pig, and thus the sample may be of a bodily fluid or secretion from a pig. Non-limiting examples of pigs from which samples may be obtained for use with the present invention include boar, sow, fattener, gilt, nursery pigs, finishing pigs, and weaned pigs. The pigs may range in age from 1 day to at least 60 days, such as from 1 day to about 30 days, 30 days to about 40 days, 41 days to about 50 days, or 51 days to about 60 days or older.

The binding agent preferably, or substantially selectively, binds an antibody against 180-kDa to 350-kDa of PEDV spike protein as found in multiple PEDV strains and isolates. In other embodiments, the binding agent does not cross react with other porcine viruses, such as circovirus, porcine parvovirus (PPV), Japanese encephalitis virus (JEV), rotavirus, pseudorabies, encephalomyocarditis virus, swine influenza virus, PRRSV or transmissible gastroenteritis (TGE) virus.

The binding agent is preferably a 180-kDa to 350-kDa of PEDV spike protein, or a fragment thereof, which binds 180-kDa to 350-kDa of PEDV spike protein antibodies. Accordingly, the disclosure provides an immunochromatographic-based method for detecting PEDV. FIG. 6 provides a Western blot illustrating detection of antibodies against 180-kDa to 350-kDa of PEDV spike protein. With reference to FIG. 6, pigs in cases 1 and 2 maintained healthy status without diarrhea, but pigs in cases 3 and 4 had severe diarrhea caused by PEDV.

The 180-kDa to 350-kDa of PEDV spike protein may be generated by any appropriate method known in the art. Suitable methods include, but are not limited to recombinant, extraction, and/or synthetic methods.

As explained herein, the binding agent may be labeled to facilitate its detection, such as, for example, by attachment to another moiety. The moiety is preferably a detectable label, including a directly detectable label, such as a radioactive isotope, a fluorescent label (Cy3 and Cy5 as non-limiting examples) or a particulate label. Non-limiting examples of particulate labels include latex particles, metal sols, and colloidal gold particles. Alternatively, the label may be for indirect detection. Non-limiting examples of labels suitable for indirect detection include an enzyme, such as, but not limited to, luciferase, alkaline phosphatase, and horse radish peroxidase. Other non-limiting examples include a molecule bound by another molecule, such as, but not limited to, biotin, an affinity peptide, or a purification tag. Preferably, the label is covalently attached.

The binding agent may be used to detect antibodies against 180-kDa to 350-kDa of PEDV spike protein in a sample of a biological fluid from a subject as described herein. The sample is preferably from an individual suspected of being infected with PEDV due to the presence of symptoms indicative of an infection. Alternatively, embodiments of the disclosed method may be used as part of routine screening of animals, such as those of a farm to permit rapid identification and isolation of infected individuals. Certain embodiments also may be used in specific instances, such as prior to transport or transfer of an animal from one location to another to permit identification of infection and prevent spread of infection.

Also disclosed herein are embodiments of a kit comprising a binding agent, or a composition and/or device comprising the binding agent, for use in one or more embodiments of the method disclosed herein. Such kits optionally further comprise an identifying description or label or instructions relating to their use in the methods of the present invention. Such a kit may comprise containers, each with one or more of the various reagents (typically in concentrated form) or devices utilized in the methods. A set of instructions will also typically be included.

Embodiments of a kit comprising a device may further comprise one or more additional reagents or pieces of equipment for use with the device. Non-limiting examples of additional materials for inclusion are sample diluent solution, diluent vial, and a dropper for transfer of sample.

IV. Examples

Example 1

Preparation of PEDV Proteins and/or Antigens

PEDV proteins may be prepared from a PEDV strain by infecting susceptible cells in vitro or in vivo, and harvesting the infected cells at an optimal time to prepare cell-associated viral components. For in vitro methods, the antigen(s) may be prepared by a cell culture system or by using recombinant technologies.

In an exemplary embodiment, MARC cells were pelleted by centrifugation, and the supernatant was removed or discarded. The pellets may be optionally washed. PEDV proteins and antigens were extracted from the cell pellets by suspending the cell pellets in a 0.05M tris (hydroxymethyl) aminomethane 0.025M EDTA buffer containing 0.5% Triton X-100 at a volume of 5-10 times that of the packed cells. The mixture was stirred for 2-15 hours at 4° C. and then centrifuged at 10,000 g for 1 hour. In another example, the mixture was stirred for 0.5-10 hours at 4-25° C. and filtered to remove cell debris.

The resulting supernatant comprised the PEDV proteins and antigens. Optionally, the antigen-containing solution may then undergo one or more freeze-thawing cycles, one or more of each, followed by an additional extraction cycle, to further break up intact cells and increase the efficiency of the extraction process. The freeze-thawing process also may facilitate ensuring that the antigen solution is non-infectious and allowing its use without a risk of spreading the virus.

FIG. 1 provides a photograph of a Western blot of PEDV proteins. The proteins were obtained from infected cells by an exemplary embodiment of the disclosed method and were mixed with one of two monoclonal antibodies, 6C8 or 3F12, which were selected to detect certain PEDV proteins. Lanes identified as 'S' contained pre-stained protein molecular weight markers. The other lanes contained samples from a PEDV infected cell culture medium at the end of culture (lanes 1), an extract of isolated PEDV infected cells diluted 2× (lanes 2), an extract of isolated PEDV infected cells diluted 3× (lanes 3), an extract of isolated PEDV infected cells diluted 4× (lanes 4), and an extract of isolated PEDV infected cells diluted 5× (lanes 5). Surprisingly, in this example, both of the monoclonal antibodies used appeared to detect proteins with the same molecular weight.

Figure 2:
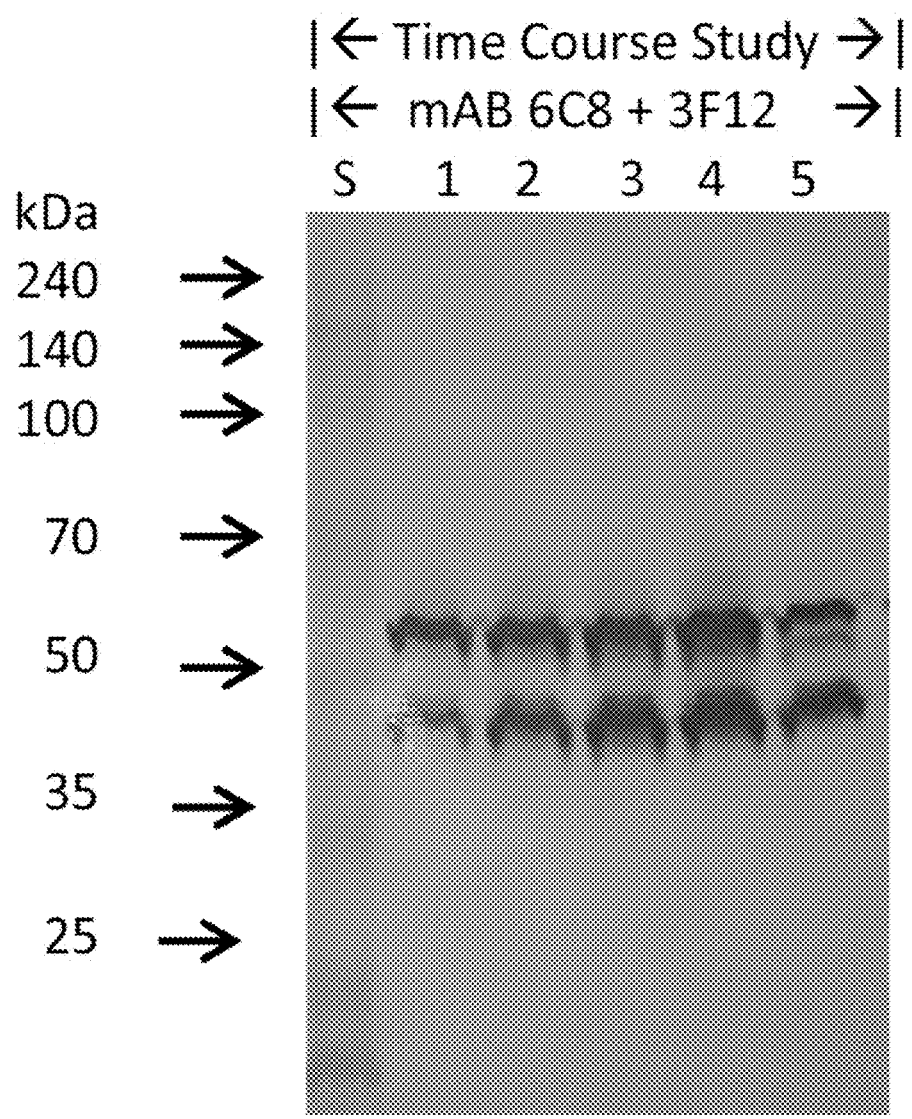
FIG. 2 is a Western blot of PEDV proteins from cultures of infected cells over time, with a mixture of the two monoclonal antibodies used in FIG. 1.

FIG. 2 provides a photograph of a Western blot of PEDV proteins from cultures of infected cells over time with a mixture of the two monoclonal antibodies used in FIG. 1. Lane S contained pre-stained protein molecular weight markers. The other lanes contained extracted samples from isolated PEDV infected cells 24 hours post infection (lane 1), 30 hours post infection (lane 2), 35 hours post infection (lane 3), 47 hours post infection (lane 4), and 52 hours post infection (lane 5).

The results from these two experiments demonstrated that the disclosed method successfully extracted proteins from cells infected with PEDV. Moreover, the Western blots illustrate that the extraction method results in a concentrated mixture of proteins compared to a culture medium, such as the culture medium of a killed virus vaccine. The concentration of proteins in the extracts or eluents may be more than twice the concentration of proteins in the culture medium, such as 4 times, 6 times, 8 times, 10 times or more than 10 times the concentration of proteins in the culture medium.

Example 2

Vaccine Preparation Comprising PEDV Proteins and/or Antigens

A vaccine was prepared using the method described in Example 5 from an exemplary antigen solution prepared by the disclosed method. The vaccine was administered to sows at 3-5 days pre-farrow in an endemic herd, 150 days post clinical break. FIG. 3 shows the data from a test where the vaccinated and non-vaccinated sows were kept in the same room. FIG. 4 shows data from a test where vaccinated and non-vaccinated sows were kept in separate rooms. The piglet mortality rates in FIGS. 3 and 4 are 15% and 9.6%, respectively, for piglets from the vaccinated sows, compared to 28% and 17.6%, respectively, for piglets from non-vaccinated sows. FIG. 5 provides baseline data from non-vaccinated herds from multiple farms, illustrating the pre-wean mortality based on days post initial whole herd PEDV virus exposure. The data in FIGS. 3-5 clearly illustrates the efficacy of the exemplary vaccine prepared by the disclosed method.

Example 3

Preparation of Porcine Deltacoronavirus Proteins and/or Antigens

Porcine deltacoronavirus (PDCoV) proteins and/or antigens may be prepared from a PDCoV strain by infecting susceptible cells in vitro or in vivo, and harvesting the infected cells at an optimal time to prepare cell-associated viral components. For in vitro methods, the antigen(s) may be prepared by a cell culture system or by using recombinant technologies.

Cells are pelleted by centrifugation, and the supernatant is removed or discarded. The pellets may be optionally washed. Porcine delta coronavirus proteins and antigens are extracted from the cell pellets by suspending the cell pellets in a buffer, such as 0.05M tris (hydroxymethyl) aminomethane 0.025M EDTA buffer containing 0.5% Triton X-100 at a volume of 5-10 times that of the packed cells. The mixture is stirred for 2-15 hours at 4° C. and then centrifuged at 10,000 g for 1 hour. The resulting supernatant comprises the PDCoV proteins and antigens. Optionally, the antigen-containing solution may then undergo one or more freeze-thawing cycles, one or more of each, followed by an additional extraction cycle, to further break up intact cells and increase the efficiency of the extraction process. The freeze-thawing process also may facilitate ensuring that the antigen solution is non-infectious and allowing its use without a risk of spreading the virus.

Example 4

PEDV proteins may be prepared from a PEDV strain by infecting susceptible cells in vitro or in vivo, and harvesting the infected cells at an optimal time, typically from 24 to 60 hours post infection, to prepare cell-associated viral components. For in vitro methods, the antigen(s) may be prepared by a cell culture system or by using recombinant technologies.

In an exemplary embodiment, the supernatant containing whole virus particles was poured off from the cells and removed or discarded. The cells may optionally be washed. PEDV proteins and antigens were extracted from the cell by suspending the cell pellets in a 0.05M tris (hydroxymethyl)

aminomethane 0.025M EDTA buffer containing 0.5% Triton X-100 at one fifth to one eighth volume of culture supernatant volume. The cells were incubated with the buffer for 20 minutes to 1 hour at room temperature (25° C.) and then optionally frozen. The resulting extract comprised the PEDV proteins and antigens. Optionally, the antigen-containing solution may then undergo one or more freeze-thawing cycles, followed by an additional extraction cycle, to further break up intact cells and increase the efficiency of the extraction process. The freeze-thawing process also may facilitate ensuring that the antigen solution is non-infectious and allowing its use without a risk of spreading the virus. The freeze-thawed solution may be filtered or centrifuged to remove cell debris. After this extraction process it was found that the proteins and antigens were inactivated. Optionally, an inactivating agent such as binary ethyleneimine is added to insure inactivation.

Example 5

Vaccine Preparation

Detergent extracts (DE samples) were prepared from MARC (monkey kidney) cells infected with Colorado (CO), Iowa (IA), and North Carolina (NC), SEQ ID NO: 1, SEQ ID NO: 2, and SEQ ID NO: 3, respectively (FIGS. 7-9). FIG. 7 is a Western blot of the detergent extracts. For each extract, 2×, 3×, and 4× diluted samples were run (lanes 1-3, respectively). A sample of each full grown virus culture also was run (lane 4).

The three DE samples were mixed in equal volume to make 1,000 mL to form a DE mixture. The DE mixture was inactivated with binary ethyleneimine (BEI) and neutralized with sodium thiosulfate. The resulting solution had a volume of about 1,200 mL. Samples taken before and after the inactivation process were tested to confirm that there was no live virus in the DE mixture after the inactivation process. FIG. 8 is a Western blot of the three DE extracts (lanes 1-3), the DE mixture before inactivation (lane 4), the DE mixture after inactivation (lane 5), and a mixture of the three viral cultures in equal volume.

The inactivated DE mixture was split into two parts –850 mL (Part A) and 350 mL (Part B). Part A was diluted with PBS (650 mL) and mixed with 300 mL of Emulsigen-D adjuvant (Phibro Animal Health Corporation, Omaha, Nebr., USA) to form an intramuscular (IM) vaccine (2 mL/dose). Part B was not diluted and was mixed with 70 mL of CARBIGEN™ adjuvant (Phibro Animal Health Corporation, Omaha, Nebr., USA) to form an intranasal (IN) vaccine (1 mL/dose). Each mixture was blended with an industrial grade blender (Commercial Blender 7011, Model 31BL92, Dynamic Corporation of America, New Hartford, Conn.). The blended solution was aliquoted into 50 mL batches for IM vaccine or 20 mL batches for IN vaccine, and stored until use. In trials, the IN vaccine was also used as a subcutaneous (SQ) vaccine.

Example 6

Pre-Wean Mortality in Vaccinated and Unvaccinated Pigs

Table 1 shows multiple farm examples of pre-wean mortality based on days post initial whole herd PEDV exposure. The data was used as a baseline to compare vaccine performance.

TABLE 1

| Days post exposure | Farm 1 | Farm 2 | Farm 3 | Farm 4 | Farm 5 | Farm 6 | All farm average |
|---|---|---|---|---|---|---|---|
| 1-7 | 100 | 99 | 97 | 100 | 97 | 100 | 98% |
| 8-15 | 98 | 94 | 98 | 98 | 100 | 100 | 98% |
| 16-23 | 51 | 47 | 78 | 89 | 90 | 100 | 76% |
| 24-31 | 23 | 24 | 34 | 54 | 45 | 100 | 46% |
| 32-39 | 19 | 14 | 27 | 43 | 34 | 100 | 39% |
| 40-47 | 19 | 25 | 17 | 30 | 16 | 22 | 21% |
| 48-55 | 24 | 12 | 18 | 27 | 20 | 37 | 23% |
| 56-63 | 19 | 11 | 16 | 25 | 19 | 32 | 20% |
| Individual farm average prior to PEDV | 15% | 14% | 15% | 20% | 17% | 12% | |

In one trial sows received the PEDV vaccine 3-5 days pre-farrow (endemic infection, 150 days post clinical break). Treated and non-treated litters were in the same room. Table 2 summarizes the results.

TABLE 2

| | Born alive | Pigs remaining at weaning | Piglet mortality |
|---|---|---|---|
| Vaccinated sows - 10 head, 2 cc dose | 133 (13.3 avg.) | 113 (11.3 avg.) | 15% |
| Non-vaccinated sows, 33 head | 405 (12.2 avg.) | 291 (8.8 avg.) | 28% |

In another trial, sows received the vaccine at 3-5 days pre-farrow (1 cc dose) in an endemic herd (150 days post clinical break) where all litters within a room were vaccinated or non-vaccinated. The results are shown in Table 3.

TABLE 3

| | # of litters | Born alive | Pigs weaned | Pre-wean mortality |
|---|---|---|---|---|
| Entire room vaccinated | 128 | 1466 (11.4 avg.) | 1324 (10.3 avg.) | 9.6% |
| No vaccine used in room | 88 | 1059 (12.0 avg.) | 872 (9.9 avg.) | 17.6% |

In another trial, nursing piglets were vaccinated intranasally between 2-4 days of age (endemic farm, 150 days post clinical break). Table 4 summarizes the results.

TABLE 4

| | Vaccinated nursing piglets (1 cc dose) | Non-vaccinated nursing piglets |
|---|---|---|
| # of litters exhibiting clinical scour | 5 of 15 litters (33%) | 8 of 27 litters (30%) |
| # of litters where all pigs died | 0 of 15 litters (0%) | 5 of 27 litters (18%) |
| Piglet mortality | 22% | 44% |
| Piglet morbidity | 12% | 13% |

In another trial, PEDV vaccine was administered intramuscularly to nursing piglets in an endemic herd (150 days post clinical break). The results are shown in Table 5.

TABLE 5

| | Born alive | Pigs remaining at weaning | Pre-wean mortality |
|---|---|---|---|
| Nursing piglets 1 cc IM, 2-3 days old, 7 litters | 79 (11.2 avg.) | 60 (8.6 avg.) | 24% |
| Nursing piglets 2 cc IM, 2-3 days old, 7 litters | 81 (11.5 avg.) | 72 (10.3 avg.) | 11% |
| Nursing piglets no vaccine | 265 (11.0 avg.) | 191 (7.9 avg.) | 28% |

In another trial, PEDV vaccine was administered to PEDV naïve isowean pigs at weaning on Day 0. Vaccines were administered subcutaneously (SubQ), intramuscularly (IM), or intranasally (IN). The pigs were weighed and given a booster vaccine on Day 21. The pigs were challenged and weighed on Day 45, and weighed again on Day 56. The results are shown in Table 6.

TABLE 6

| Group | Wean weight and 1st vaccination (Day 0) | Booster vaccination weight (Day 21) | Day of challenge weight (Day 45) | End weight (Day 56) |
|---|---|---|---|---|
| Controls (red tags) | 12.9 | 24.9 | 44.6 | 54.1 |
| SubQ vaccination (green tags) | 13.6 | 23.5 | 50.8 | 61.3 |
| IN vaccination (pink tags) | 13.3 | 27.8 | 51.0 | 66.6 |
| IM vaccination (purple tags) | 13.4 | 27.4 | 48.8 | 68.0 |

Table 7 shows the average daily gain for days 1-45 post vaccination and days 1-11 post challenge.

TABLE 7

| Group | ADG Days 1-45 post vaccination | ADG Days 1-11 post challenge |
|---|---|---|
| Controls (red tags) | 0.71 | 0.85 |
| SubQ vaccination (green tags) | 0.83 | 0.95 |
| IN vaccination (pink tags) | 0.84 | 1.41 |
| IM vaccination (purple tags) | 0.79 | 1.75 |

Fecal shedding was evaluated 11 days post challenge in naïve isowean pigs. The values shown in Table 8 are PCR cycle times (CT) values. The lower the number, the higher the level of viral material in the sample. The negative cut-off is 35.

TABLE 8

| Group | Average CT value | Range in CT values |
|---|---|---|
| Controls | 28.3 | 21.9-33.0 |
| SubQ vaccination | 32.8 | 30.0-33.1 |
| IN vaccination | 26.2 | 21.3-30.0 |
| IM vaccination | 32.4 | 31.2-34.7 |

In another trial, the disclosed vaccine (MJ PEDV) was evaluated against a commercial PEDV vaccine in an endemic farm 150 days post clinical break. The vaccines were administered 3-5 days pre-farrow. The results are summarized in Table 9. The data is a composite of three farrowings in which all three groups were scattered throughout rooms.

TABLE 9

| | # of litters | Born alive | Pigs remaining | Pre-wean mortality |
|---|---|---|---|---|
| MJ PEDV 1 cc IM | 36 | 412 (11.4 avg.) | 357 (9.9 avg.) | 13.3% |
| Commercial PEDV 1 cc IM | 50 | 598 (11.9 avg.) | 458 (9.1 avg.) | 23.4% |
| Non-vaccinates | 33 | 422 (12.7 avg.) | 311 (9.4 avg.) | 26.3% |

In another trial, the disclosed vaccine (MJ PEDV) was evaluated against two commercial PEDV vaccines during an acute outbreak. Sows farrowed 9 to 22 days post PEDV whole herd feedback. The results are shown in Table 10.

TABLE 10

| Group treatment | Sow dosage of vaccine | Days farrowed post feedback exposure | Number of litters in group | Average born alive | Viable pigs remaining at 16 days of age | Pre-wean mortality |
|---|---|---|---|---|---|---|
| Controls | No vaccine | 9-21 days | 6 litters | 13.1 | 6.1 | 53.4% |
| Commercial vaccine 1 | 2 cc/2 cc | 10-22 days | 6 litters | 7.8 | 4.8 | 38.4% |
| Commercial vaccine 2 | 2 cc/2 cc | 9-21 days | 7 litters | 12.4 | 7.2 | 41.9% |
| MJ | 2 cc/2 cc | 12-22 days | 10 litters | 9.3 | 6.9 | 25.8% |

Example 7

PEDV Active Farm Trials

A farm experienced an outbreak of PEDV. After feeding back, the herd had stabilized. A few months after the initial outbreak, bringing in naïve gilts acclimated for PEDV caused a second PEDV event on the farm. The farm was farrowing 145-150 sows/week. Each farrowing room included 44 crates; each farrowing group occupied 3+ farrowing rooms.

Five litters in Room #1 may be selected at 5 days old (day zero). Each piglet may be given 1 mL of IN vaccine, and the immunized piglets may be marked. Mortality may be compared between vaccinated and unvaccinated litters at weaning during days 14-19.

Rooms 2-4 may include sows bred at the same time. Sows in Room #2 and half the sows in Room #3 may not be vaccinated. The remaining sows in Room #3 and the sows in Room #4 may be vaccinated with IM vaccine (2 cc/sow) on day zero. The sows may farrow on days 14-19. Five litters at 5 days old (days 21-26 post sow vaccine) may be selected from Room #4; the selected piglets may be immunized with 1 mL of IN vaccine and marked. On days 37-44 post sow vaccination, mortality may be compared at weaning among litters that receive no vaccine, litters in which the sows receive IM vaccine and the piglets are unvaccinated, and litters in which the sows receive IM vaccine and the piglets receive IN vaccine.

Rooms 5-7 may include sows bred at the same time. Sows in Room #5 and half the sows in Room #6 may not be vaccinated. The remaining sows in Room #6 and the sows in Room #7 may be vaccinated with IM vaccine (2 cc/sow) on day zero. The vaccinated sows may receive a booster vaccination 14-19 days post initial vaccination. The sows may farrow on days 28-34 post initial vaccination. Five litters at 5 days old may be selected from Room #7 on days 33-39; the piglets may be vaccinated with 1 mL of IN vaccine and marked. On days 47-53, mortality may be compared at weaning among litters that receive no vaccine, litters in which the sows receive IM vaccine and the piglets are unvaccinated, and litters in which the sows receive IM vaccine and the piglets receive IN vaccine.

Example 8

Comparison of Vaccination Protocols

Sows and/or piglets were immunized intramuscularly with 1-4 cc of PEDV vaccine. The piglets were monitored to determine the effect on mortality.

TABLE 11

Room 3

| Dose/ pig IM | # litters vacci- nated | Total pigs vacci- nated | Born alive per litter | Pigs wean vaccinated | Pigs weaned per litter | Piglet mortality |
|---|---|---|---|---|---|---|
| 1 cc | 7 | 79 | 11.2 | 60 | 8.6 | 24% |
| 2 cc | 7 | 81 | 11.5 | 72 | 10.3 | 11.1% |
| — | 24 | 265 | 11.0 | 191 | 7.9 | 28% |

One litter in the 1 cc group of pigs had severe scours.
Pigs were vaccinated at 1-2 days of age.
Pigs were weaned at 17-19 days of age.

TABLE 12

Room 4

| Dose/ pig IM | # sows vacci- nated | Born alive per litter | Pig inven- tory from vaccinated sows | Pig inven- tory at 15 days of age | Piglet mortality |
|---|---|---|---|---|---|
| 2 cc | 10 | 11.2 | 112 | 99 | 11.6% |
| — | 33 | 12.1 | 399 | 333 | 16.7% |

Sows were given vaccine between day of farrowing out to day 6 pre-farrow.
Average timing was 2.2 days pre-farrow for vaccinated sows.

TABLE 13

Room 5

| Dose/ pig IM | # sows vacci- nated | Born alive per litter | Pig inven- tory from vaccinated sows | Pigs remaining | Piglet mortality |
|---|---|---|---|---|---|
| 4 cc | 10 | 13.3 | 133 | 113 | 15% |

Example 9

Vaccination of PEDV Naïve Pigs

Forty PEDV naïve isowean pigs (20 days old) may be divided into 4 groups randomly and tagged (Groups A, B, C, and D). Four days later, each pig may be weighted and a blood sample obtained before vaccination. On day zero, Group A may receive 2 ml of a control vaccine, Group B may receive 2 mL of IM vaccine, Group C may receive 1 mL of IN vaccine (0.5 mL×2 spots), and Group D may receive 1 mL of SQ vaccine (0.5 mL×2 spots). On day 21, blood samples may be obtained and each pig may receive a booster vaccination. On day 34, the pigs may be moved to a new location. On day 35, a third blood sample may be obtained, and the pigs may be challenged by giving each pig 1 mL of "gut-homogenizer" by mouth. Each pig's behavior may be observed daily for two weeks. On day 41 (6 days post challenge), a fourth blood sample may be obtained. On day 45 (10 days post challenge), a fifth blood sample may be obtained.

Example 10

Vaccination of Sows Previously Exposed to PEDV

A PED stabilized farm may be selected. Sero-converting gilts may be kept by the PEDV-feedback method. $P_0$ sows may be identified in 4 groups—8, 6, 4, and 2 prefarrowing groups, 30 gilts per group (15 for control, and 15 for vaccination). Blood samples may be obtained before vaccination. Pigs may be vaccinated with 2 mL of IM vaccine; controls may receive PBS+adjuvant. Blood samples may be obtained before a booster vaccination (2 mL of IM vaccine) at 2, 3, or 4 weeks later.

TABLE 14

| | Group | | | |
|---|---|---|---|---|
| Day | I | II | III | IV |
| 0 | B, V | B, V | B, V | B, V |
| 7 | | | | |
| 14 | B, F | B, V | | |
| 21 | Observe piglet performance (OPP) | | B, V | |
| 28 | OPP | B, F | | B, V |
| 35 | OPP | OPP | | |
| 42 | OPP | OPP | B, F | |
| 49 | | OPP | OPP | |
| 56 | | | OPP | B, F |
| 63 | | | OPP | OPP |
| 70 | | | | OPP |
| 77 | | | | OPP |

B = blood sample,
V = vaccination,
F = farrowing

Example 11

PEDV proteins usable in vaccines may be prepared from a PEDV strain by infecting susceptible cells in vitro or in vivo, and harvesting the infected cells at an optimal time to prepare cell-associated viral components. For in vitro methods, the antigen(s) may be prepared by a cell culture system or by using recombinant technologies.

For instance, MARC cells can be grown in cell culture and infected with PEDV either with or without the addition of trypsin. The trypsin is added at a concentration that will help the virus infect the cells sheet without destroying the cells. For instance, at a concentration of 1-10 µg/mL. Once the cells show evidence of infection by the PEDV, the culture medium is removed and discarded. The cells may be optionally washed. A buffer such as Tris or phosphate buffered saline (PBS) with EDTA is added, swirling to coat the cell sheet and then the PEDV proteins and antigens are extracted by placing the culture vessels (roller bottles, flasks, beads or other types of matrix) with the buffer into a freezer at a temperature at or below −10° C. The vessels are allowed to freeze and then are thawed. Thawing breaks open the cells and releases the PEDV proteins and antigens useful for preparation of a vaccine. Optionally, the thawed culture may be refrozen and rethawed to release more proteins and antigens and optionally filtered or centrifuged to remove cell debris. After release of the proteins/antigens, an inactivating agent such as binary ethyleneimine (BEI), formalin, beta propiolactone (BPL) or any other effective inactivating agent is added while mixing. Mixing of the inactivating agent with the culture is continued until inactivation is complete, usually at least 30 minutes. After inactivation, the solution of viral protein and antigens may be diluted with proper buffer solution like PBS and excipients, and adjuvanted or adjuvanted without further dilution. Acceptable adjuvants include oil-in-water adjuvants such as those containing EMULSIGEN®, adjuvants comprising polymers such as those comprising acrylic acids or carbomers such as CARBIGEN™, or other types of polymers such as POLYGEN™. Once the antigens are inactivated and adjuvanted they may be administered to animals, preferably pigs, via intramuscular, subcutaneous, intranasal or oral routes.

Example 12

An autogenous immunogenic composition comprising coronavirus proteins and antigens is produced from a sample received from an infected subject. The subject may be a swine. The sample is analyzed to determine if it is infected with a coronavirus, and if so, to determine the species and strain of the virus. The virus is then replicated and the proteins and antigens isolated by the method disclosed herein to produce an immunogenic composition. Optionally, an adjuvant may be added to the composition. An autogenous immunogenic composition produced by the disclosed method is typically administered to one or more of: (1) the infected subject; (2) other subjects in an infected population that includes or included the infected subject; (3) subjects that may have or have had contact with the infected subject; or (4) subjects in close proximity to the infected subject, such as a neighboring building, field or farm.

Optionally, one or more coronavirus strains of the same species are identified and/or selected for the production of a combination immunogenic composition. Additionally, or alternatively, isolated proteins and antigens from one or more additional coronavirus species and/or non-coronavirus species may be included in the immunogenic composition. The additional strain(s) and/or species may be selected to produce an improved immune response in a subject when administered in combination with proteins and antigens from the received sample, selected based on prior and/or current infection history of the subject or the subject's location, selected to protect the subject from potential future infection, or any combination thereof.

In view of the many possible embodiments to which the principles of the disclosed invention may be applied, it should be recognized that the illustrated embodiments are only preferred examples of the invention and should not be taken as limiting the scope of the invention. Rather, the scope of the invention is defined by the following claims. We therefore claim as our invention all that comes within the scope and spirit of these claims.

SEQUENCE LISTING (63 sequences)

SEQ ID NO: 1 - DNA, 28038 bp, porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaactagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccmtgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactctcttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 2 - DNA, 28039 bp, porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcggtctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacttgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaaggttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 3 - DNA, 28038 bp, porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgttagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttttagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacactcgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttctctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaacactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgacgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaatacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctttatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttttgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcactggttatgctgccaatgtatttgctactgagcccaatggccacataccagaaggttttagttttaataattggtttcttttgtccaatgattccactttggtgcatggtaaggtggtttctaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtgatgttaagtttacgtccctttactttcaattcacaaagggtgagttgattactggcacgcctaaaccatttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaattttgaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 4 - DNA, 27989 bp, porcine epidemic diarrhea virus
ctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcgcttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgataagctggtgttgtttacaaattccaatttggatttttgtagcgttggtaagtgtcttaacaatgtgaccggcggtgcattgcttgaagccataaatgtatttaaaaagagtaacaaaacagtgcctgctggcaactgtgttacttttgagtgtgcagacatgatttctattactatggtagtattgccatctgatggtgatgctaattatgacaaaaattatgcacgcgccgtcgtcaaggtatctaagcttaaaggcaagttattgcttgctgttggtgatgccacgttgtattccaagttgtcccatctcagcgtggtaggtttcgtatccacacctgatgatgtggagcgtttctacgcaaataagagtgtggttattaaagtcactgaggatacacgtagtgttaaggctgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgtctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtccaagtacattgtttctgctggttctgtcactattgaacgtgtcacgcatgacggctgttgttgtagtaagcgtgttgtcactgcaccagttgtgaatgctagcgtattgaagcttggcgtcgaggatggtctttgtccacatggtcttaactacattgacaaagttgttgtagttaaaggtactacaattgttgtcaatgttggaaaacctgtagtggcaccatcacacctctttcttaagggtgtttcttacacaacattcctagataatggtaacggtgttgtcggccattatactgtttttgatcatgacactggtatggtgcatgatggagatgcttttgtaccgggtgatctcaatgtatctcctgttacaaatgttgtcgtctcagagcagacggctgttgtgattaaagaccctgtgaagaaagtagagttagacgctacaaagctgttagacactatgcattatgcatcggaaagattcttttcctttggtgattttatgtcacgtaatttaattacagtgtttttgtacatccttagcattttgggtctctgttttagggcctttcgtaagagggatgttaaagttctagctggtgtaccccaacgtactggtattatattgcgtaaaagtgtgcgctataatgcaaaggcgttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcagacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgctaccgacaggtcctgccactattcttattgacaaggttgaattcagtaatggtttttactatctttatagtggtgacacattttggaagtacaactttgacataacagatagcaaatacacttgcaaagaatcacttaaaaattgtagcataatcacagactttattgtttttaacaataatggttccaatgtaaatcaggttaagaatgcatgtgtttatttttcacagatgctttgtaaacctgttaagttagtggactcagcgttgttggccagtttgtctgttgattttggtgcaagcttacatagtgcttttgttagtgtgttgtcgaatagttttggcaaagatctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaatttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataaccttcatgttgacctttaatgattgtcgtatgcacactaccatacctactgtttgcattgcaaataagaagggtgcaggtcttcctagtttttcaaaggttaagaaattcttctggtttttgtgtctgttcatggttgctgttttctttgcactaagctttcttgattttagtactcaggttagcagtgatagcgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagctcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatttcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcttacattgtaacacagaacacacttggcatgttgggctatgcaactttgtacttcttgtgcactaaaggtgttagatatatgtggatttggcatttgggatttttgatctcatatatacttattgcaccatggtgggttttgatggtttatgccttttcggccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaatgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatgtgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccaggtgaatcttttaatatcttggcgtgctatgatggtgctgcagctggtgtttatggcgttaacatgcgctctaattacactattagaggctcgttcattaatggcgcttgtggttcacctggttataatattaacaatggtaccgttgagttttgctatttacatcagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtaggtaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgcagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgttcttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgatgactgcggcatataactatttttacgctagtgacattcttagttgtgctatgacactatttgctagtgtgactggcaactggttcgttggtgctgtttgttataaagctgctgtttatattgccttgagatttcctacttttgtggctatttttggtgatattaagagtgttatgttctgttaccttgtgttgggttattttacctgttgtttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttggatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcaagagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccattacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagttaagtgggagttcgatggtggttgtaacactattgagctagaaccaccacgtaagttcttggtggattctcctaatggtgcacagatcaagtatctctactttgttcgtaaccttaacacgttacgtaggggtgctgttcttggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgcgttaagatgttggccaatggttctggtaatggacaagctgttactaatggtgtggaggctagtactaaccaggattcatacggtggtgcttccgtgtgtctatattgtagagcacatgttgagcatccatctatggatggtttttgcagactgaaaggcaagtacgtacaggtgccactaggtacagtggatcctatacgttttgtacttgagaatgacgtttgcaaggtctgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagctgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggctatcactccatatgtgtgttgtgcttcagattgtggtgtcaatgatgtaactaagctctacttaggtggtcttagttattggtgtcatgaacacaagccacgtcttgcattcccgttgtgttctgctggtaatgtttttggtttgtacaaaaattctgctaccggctcacccgatgttgaggactttaatcgcattgctacatccgattggactgatgtttctgactacaggttggcaaatgatgtcaaagactcattgcgtctatttgcagcggaaactatcaaggccaaggaggagagcgttaagtcatcctacgcttgtgcaacactacatgaggttgtaggacctaaagagttgttgctcaaatgggaagtcggcagacccaaaccacctcttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcaccctgcttttaacatacctgaagcttattctagcttagtgccctattaccaactgattggtaagcagaagattacaactatccagggacctccaggtagtggtaaatctcactgtgttatagggctaggtttgtactatccaggtgcacgtatagtgtttacagcttgttctcatgcagcggtcgattcactttgtgtgaaagcctccactgcttatagcaatgacaaatgttcacgcatcataccacagcgtgctcgtgttgagtgttatgacggtttcaagtctaataatactagtgctcagtaccttttctccactgtcaatgctttgccagagtgcaatgcggacattgttgtggtggatgaggtttctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgcactgtgtctgagatggtctatgaaaaccaattcattcctgtgcacccagatagcaagcagtgttttaaaatcttttgcaagggtaatgttcaggttgacaatggttcaagcatcaatcgcaggcaattggatgttgtgcgtatgtttttggctaaaaaccctaggtggtcaaaggctgtttttatttctccttataacagccagaattatgttgccagccgcatgctaggtttacaaattcagacagttgactcatcccagggtagtgagtatgactatgtcatttatacacaaacttcagatactgcccatgcctgtaatgttaacaggtttaatgttgccatcacaagggctaagaaaggcatattatgtataatgtgcgataggtccctttttgatgtgcttaaattttttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggcttccgttttgatatcaacatacccaaccatcacactctcttttgcacacgcgactttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactacattaaacccgtcagagctcgtgctccaccaggggaacaatttgcacaccttttgcctctacttaaacgcggccaaccatgggatgtggttcgtaagcgtatagtgcaaatgtgtagtgactacctggctaacctatcagacatactaatttttgtgttgtgggctggtggtttggagttgacaactatgcgttactttgtcaagattggaccaagcaagagttgtgattgtggtaaggttgctacttgttacaatagtgcgctgcatacgtactgttgtttcaaacatgcccttggttgtgattacctgtacaatccatactgtattgatatacagcagtggggatacaagggatcacttagccttaaccaccatgagcattgtaatgtacatagaaacgagcatgtggcttctggtgatgccataatgactcgctgtctagccatacatgattgctttgtcaagaacgttgactggtccatcacatacccatttattggtaatgaggctgttattaataagagcggccgaattgtgcaatcacacactatgcggtcagttcttaagttatacaatccaaaagccatatatgatattggcaaccctaagggcattagatgtgccgtaacggatgctaagtggttctgctttgacaagaatcctactaattctaatgtcaagacattggagtatgactatataacacacggccaatttgatgggttgtgcttgttttggaattgcaatgtggacatgtatccagaattctctgtggtctgtcggtttgacactcgctgtaggtcaccactcaacttggagggttgtaatggtggttcactgtatgttaataatcatgcattccatacaccggcttttgacaagcgtgcttttgccaagttgaagccaatgccatttttcttctatgatgatactgagtgtgacaagttacaggactctataaactacgttcctcttagggctagtaattgcattactaaatgtaatgttggtggagctgtctgtagtaagcattgtgctatgtaccatagctatgttaatgcttacaacacctttacgtcggcgggctttacgatttgggtgcccacttcgtttgacacctacaatctgtggcagacatttagtaacaacttgcaaggtcttgagaacattgctttcaatgtcgtaaagaaaggatcttttgttggtgctgaaggtgagcttcctgtagctgtggttaatgacaaagtgctcgttagagatggtactgttgatactcttgttttcacaaacaagacatcactacccactaacgtagcttttgagttgtatgccaagcgtaaggtaggactcaccccacccattacgatcctacgtaacttgggtgttgtttgcacatctaagtgtgtcatttgggactatgaagccgaacgtccacttactacttttacaaaggatgtctgtaaatataccgactttgagggtgacgtttgcacactctttgataacagcattgttggttcattagagcgattctctatgacccaaaatgctgtgcttatgtcacttacagctgttaaaaagcttactggcataaagttaacttatggttatcttaatggtgtcccagttaacacacatgaagataaaccttttacttggtacatttacactaggaagaacggcaagttcgaggactatcctgatggctattttacccaaggtagaacaaccgctgattttagccctcgtagtgacatggaaaaggacttcctaagtatggatatgggtctgtttattaacaagtacggactcgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaatctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttttagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatgga

SEQ ID NO: 5 - DNA, 27989 bp, porcine epidemic diarrhea virus
ctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtccctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgctatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcgcgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataatattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacacctcaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaatcctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggcttccgttttgatatcaacatacccaaccatcacactctcttttgcacacgcgactttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactacattaaacccgtcagagctcgtgctccaccaggggaacaatttgcacaccttttgcctctacttaaacgcggccaaccatgggatgtggttcgtaagcgtatagtgcaaatgtgtagtgactacctggctaacctatcagacatactaatttttgtgttgtgggctggtggtttggagttgacaactatgcgttactttgtcaagattggaccaagcaagagttgtgattgtggtaaggttgctacttgttacaatagtgcgctgcatacgtactgttgtttcaaacatgcccttggttgtgattacctgtacaatccatactgtattgatatacagcagtggggatacaagggatcacttagccttaaccaccatgagcattgtaatgtacatagaaacgagcatgtggcttctggtgatgccataatgactcgctgtctagccatacatgattgctttgtcaagaacgttgactggtccatcacatacccatttattggtaatgaggctgttattaataagagcggccgaattgtgcaatcacacactatgcggtcagttcttaagttatacaatccaaaagccatatatgatattggcaaccctaagggcattagatgtgccgtaacggatgctaagtggttctgctttgacaagaatcctactaattctaatgtcaagacattggagtatgactatataacacacggccaatttgatgggttgtgcttgttttggaattgcaatgtggacatgtatccagaattctctgtggtctgtcggtttgacactcgctgtaggtcaccactcaacttggagggttgtaatggtggttcactgtatgttaataatcatgcattccatacaccggcttttgacaagcgtgcttttgccaagttgaagccaatgccatttttcttctatgatgatactgagtgtgacaagttacaggactctataaactacgttcctcttagggctagtaattgcattactaaatgtaatgttggtggagctgtctgtagtaagcattgtgctatgtaccatagctatgttaatgcttacaacacctttacgtcggcgggctttacgatttgggtgcccacttcgtttgacacctacaatctgtggcagacatttagtaacaacttgcaaggtcttgagaacattgctttcaatgtcgtaaagaaaggatcttttgttggtgctgaaggtgagcttcctgtagctgtggttaatgacaaagtgctcgttagagatggtactgttgatactcttgttttcacaaacaagacatcactacccactaacgtagcttttgagttgtatgccaagcgtaaggtaggactcaccccacccattacgatcctacgtaacttgggtgttgtttgcacatctaagtgtgtcatttgggactatgaagccgaacgtccacttactacttttacaaaggatgtctgtaaatataccgactttgagggtgacgtttgcacactctttgataacagcattgttggttcattagagcgattctctatgacccaaaatgctgtgcttatgtcacttacagctgttaaaaagcttactggcataaagttaacttatggttatcttaatggtgtcccagttaacacacatgaagataaaccttttacttggtacatttacactaggaagaacggcaagttcgaggactatcctgatggctattttacccaaggtagaacaaccgctgattttagccctcgtagtgacatggaaaaggacttcctaagtatggatatgggtctgtttattaacaagtacggactcgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaatctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgattctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctactgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgmctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagcactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctacctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaactacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatgga

SEQ ID NO: 6 - DNA, 28004 bp, porcine epidemic diarrhea virus
gactcttgtctactcaattcaactaaacgaaattccttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgmtcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgwtaaggtggcagacgtggctaactctgagcctgaggatgacggtcttaatgtagctcctgaaacaaatgtagagtctgaagttgaggaagttgccgcaaccttgtcttttaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagtcactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctcyacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatrtgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcctccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttaytggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgacaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaataggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgactaaaccacttgaaggtgtcacggacgtttcttttatgactctggatgtgtgtaccaagtatactatctatggctttaaaggtgagggtatcattacccttacaaattctagctttttggcaggtgtttattacacatctgtttctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacractcagcgctaggcttgagtctgttgaagttaactctatgcttactatttctgaagaggctctacagttagctaccattagttcgtttaatggtgatggatataattttactaatgtgctgggtgtttctgtgtatgatcctgcaaggggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatcccagcgttatggtttttgtggtggtgatggcgatcacattttctctctggtacaggcagcacctcagggcctgctgtttttacatacagtacttgtaccgggtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatctcaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattcaaagtcggtggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaayaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 7 - DNA, 27994 bp, porcine epidemic diarrhea virus
acttaaaaagattttcattctacggatagttagttctttttctagaccttgtctactcaattcaactaaacgaaattttgtccttccggccgcatgttcatgctgctggaagctggcgtggaatttcgttaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgccggctatggctagcaaccatgtcacattggcgtttgccaatgatgcagaaatttcggcttttggcttttgcactgctagtgaagccgtctcatactattctgaggccgccgctagtggatttatgcaatgccgttttgtgtccctcgatctcgctgacactgttgagggattgcttcctgaagactatgtcatggtggtgatcggcactaccaagcttagtgcgtatgtggacacttttggtagccgccccagaaacatttgtggttggctgttattttctaactgtaattacttcctcgaagagttagagctcacttttggtcgtcgtggtggtaacatcgtgccagttgaccaatacatgtgtggcgctgacgggaaacctgttcttcaggaatccgagtgggagtatacagatttcttcgctgactccgaagacggtcaactcaacattgctgggatcacttatgtgaaggcctggattgtagagcgatcggacgtctcttatgcgagtcagaatttaacatctattaagtctattacttactgttcaacctatgagcatacttttcttgatggtactgccatgaaggttgcatgtactccaaagatcaagaagaatgttgttttgtctgagccacttgctactatctacagggaaattggttccccttttgtggataatgggagcgatgctcgttctatcattaggagaccagtgttcctccacgcttttgttaagtgtaagtgtggtagttatcattggactgttggtgattggactttctatgtctccacttgctgtggctttaagtgcaagccagtccttgtgtcctcatgctctgctatgcctggttctgttgtggtcacacgcgctggtgctggcactggtgttaagtactacaacaacatgttcctgcgccatgtggctgacattgatggattggcattctggcgaattcttaaggtgtagtccaaagacgacctcgcttgctctggtaagttccttgaacaccatgaggaaggtttcacagacccttgctactttttgaatgattcgagccttgctactaagcttaagttcgacatccttagtggcaagttttctgatgaagtcaaacaagctatcattgctggtcatgttgttgttggcagtgcactcgttgacattgttgacgatgcactgggacaaccttggttcatacgtaagcttggtgaccttgcaagtgcaccttgggagcagcttaaggctgtcgttagaggccttggcctcttgtctgatgaggttgtgctctttggcaaaagacttagctgtgccactcttagtatcgttaacggcgtttttgagtttctcgccgatgtgccagagaagttggctgcggctgttacagtttttgtcaacttcttgaatgagttctttgagtctgcctgtgactgcttaaaggtcggaggtaagacattcaacaaggttggttcctatgttctttttgacaatgcattggttaagcttgtcaaggcaaaagctcgcggcccacgacaggcaggtatttgtgaagttcgctacacaagcctggttgttgggagtactaccaaggtggtttccaagcgcgttgaaaatgccaatgtgaatctcgtcgtcgttgacgaggatgtaaccctcaacaccactggtcgtacagttgtcgttgatggacttgcattcttcgagagtgacgggttttacagacatcttgctgatgctgacgctgtcatcgaacatcctgtttataagtctgcctgtgagctcaagccagtttttgagtgtgacccaatacctgattttcctttgcctgtggccgctagtgttgcagagctctgtgtgcaaaccgatctgttgcttaaaaattacaacactccttataaaacttacagctgcgtagtgagaggtgataagtgttgcatcacttgcaccttacagttcaaagcaccaagttatgtggaggatgctgttaattttgtagacctatgtaccaagaacattggtactgctggttttcatgagttttacataacggcccatgaacaacaggatctgcaagggtttttaaccacttgttgcacgatgtcaggttttgagtgttttatgcctacaatcccacagtgtccagcagtgcttgaagagattgatggtggtagcatatggcggtcttttatcactggtcttaatacaatgtgggatttttgcaagcgtcttaaagtcagctttggactggatggcattgttgtcactgtagcacgcaaatttaaacgacttggtgctcttttggcagaaatgtataacacttatctttcaactgtggtggaaaacttggtactggccggtgttagcttcaagtattatgccaccagtgtcccaaaaattgttttgggcggttgttttcacagtgttaaaagtgtttttgcaagtgtcttccagattcctgtccaggcaggcattgagaagtttaaagttttccttaactgtgttcaccctgttgtaccacgtgtcattgaaacttcttttgtggtattagaagagacgacatttaaaccaccagcactcaatggtggtattgctattgtagatggcttcgctttctattatgatggaacactatactatcccaccgatggtattagtgttgtgcctatctgttttaagaagaaaggtggtggtgatgttaaattctctgatgaagtctctgttaaaaccattgatccagtttataaggtctcccttgaatttgagttcgagtctgagactattatggctgtgcttaataaggctgttggtaatcgtatcaaggttacaggtggttgggatgatgtcgttgagtatattaacgttgccattgaggttcttaaagatcacgttgaagtgcctaagtactacatctatgatgaggaaggtggcactgatcctaatctgcccgtaatggtttctcagtggccgttgaatgatgacacgatctcacaggacctgcttgatgtggaagttgttacggatgcaccaattgattccgagggtgatgaagtagactcctctgcacctgagaaggtggcagatgtggctaactctgaacctggggatgatggtcttcctgtggcacctgaaacaaatgtagagtctgaagttgaggaagttgccgcaaccttgtcctttattaaagatacaccttctacagttaaggacccttttgcttttgactttgtaagctacggaggacttaaagttttaagacaatctcataacaattgttgggttacttctaccttggtgcagctacaattgcttggcatcgttgatgaccctgcaatggaactttttagtgctggtagagttggtccaatggttcgcaaatgttatgagtcacaaaaggctattttgggatctttgggtgatgtgtcggcttgcctagagtctctgactaaggacctacacacacttaagattacctgttctgtagtctgcggttgtggtactggtgaacgtatctatgagggttgtgcttttcgtatgacgccaactttggaaccgtttccatatggtgcttgtgctcagtgtgctcaagttttgatgcacacttttaaaagtattgttggcaccggcatcttttgccgagatactactgctctctccttggattttttggttgtaaaacctctttgtgcggctgcttttataggcagggatagtggtcattatgtcaccaatttttatgatgctgctatggctattgatggttatggtcgtcatcagataaagtatgacacactgaacaccatttgtgttaaagacgtgaattggacagcacctcttgtccctgccgttgattctgtagtggagcctgttgtcaaaccattctattcttataagaatgttgatttttaccaaggagattttagtgaccttgttaaacttccatgtgactttgttgttaatgctgcaaatgagaagttgtctcatggtggcggcatagcaaaggccattgatgtttataccaagggcatgttgcagaagtgttcaaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaactcaggtgttgctcttacacctttgattagtgttggaatttttagtgttcctttggaagaatctttatctgcttttcttgcatgtgttggtgatcgccactgtaagtgcttttgttatggtgacaaagagcgcgaggcgatcattaagtacatggatggcttggtagatgctattttcaaagaggcgcttgttgacactactcctgtccaggaagatgttcaacaagtttcacaaaaaccagttttgcctaattttgaacctttcaggattgaaggtgctcatgctttctatgagtgcaaccctgaaggtttgatgtccttaggtgctgacaagctggtgttgtttacaaattccaatttagatttttgtagtgttggtaagtgtcttaacgatgtgaccagcggtgcattgcttgaagccataaatgtatttaaaaagagtaacaaaacagtgcctgctggcaactgtgttactttagcttgtgcaaatatgatttctattactatggtagtattgccatttgatggtgatgctaattatgacaaaaattatgcacgcgccgttgtcaaagtatctaagcttaaaggcaagttagtgcttgctgttgatgatgccacgttgtattccaagttgtcccacctcagcgtgttaggtttcgtgtccacacctgacgatgtggagcgtttctacgcaaataagagtgtggttattaaagtcactgaggatacacgtagtgtcaaggctgttaaagtagaatccactgctacttatggacaacaaattggaccttgtcttgttaatgacaccgttgtcacagacaacaaacctgttgtcgctgacgttgtagctaaggttgtaccaaatgctaattgggattcacattatggttttgataaggccggtgagttccacatgctagaccatactgggtttacctttcctagcgaagttgttaacggtaggcgtgtgattaaaaccacagataataattgttgggttaatgtcacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtccaagtacattgttcctgctggttctgtcactattgaacgtgtcacgcatgacggctgttgttgtagtaagcgtgttgttactgcaccagttgtgaatgctagtgtgttgaagcttggcgtcgaggatggcctttgtccacatggtcttaactacattggcaaagttgttgtagttaaaggtactacaattgttgtcaatgtaggaaaacctgtagtggcaccatcacacctctttcttaagggtgtatcctacacaacattcctagataatggtaacggtgtcggccattatactgtttttgatcatggcactggtatggtgcatgatggcgatgcttttgtaccgggtgatcttaatgtatctcctgttacaaatgttgttgtctcagagcagacggctgttgtgattaaagaccctgtgaagaaagcagagttagacgctactaagctgctcgacactatgaattatgcatcggaaagatttttttcctttggtgatttcatgtcacgtaatttaattacagtgtttttgtacatccttagcattttgggtctctgttttagagcctttcgtaagagagatgttaaagttctagctggtgtaccccaacgtactggtattatattgcgtaaaagtatgcgctataatgcaaaggcgttgggtgtctttttcaagctaaagctttattggttcaaagttcttggtaagtttagtctgggtatttatgcattgtatgcattactattcatgacaatacgctttacacctataggtagccccgtctgtgatgatgttgttgctggttatgctaattctagttttgacaagaatgagtactgcaacagtgttatttgtaaggtctgtctctatgggtaccaggaactctcggacttctcccacacacaggttgtatggcaacatcttagagacccattaattggtaatgtgatgcctttcttttatttggcatttttggcaatttttgggggtgtctatgtaaaggctattactctctattttattttccagtaccttaatagtcttggtgtgtttttgggcctacagcagtccatttggtttttgcagctcgtgccttttgatgtctttggtgatgagatcgtcgtctttttcatcgttacacgcgtattgatgttcattaagcatgtttgccttggctgcgataaggcatcttgtgtggcttgctctaagagtgctcgccttaagcgcgctcctgtccagactatctttcagggtactagtaaatccttctacgtacatgccaatggtggttctaagttctgtaagaagcacaatttcttttgtttaaattgtgattcttatggtccaggctgcacttttattaacgacgtcattgcaactgaagttggtaatgttgtcaaacttaatgtgcaaccgacaggtcctgccactattcttattgacaaggttgaattcagtaatggtttctactatctttatagtggtgacacattttggaagtacaactttgacataacagatagcaaatacacttgcaaagaggcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagtttcggcaaagacctgtcaagttgtaatgacatgcaggattgcaagagcacattgggttttgatgatgtaccattggatacctttaatgctgctgttgctgaggctcatcgctatgatgtcctcttgactgacatgtcattcaacaattttaccaccagttatgcaaaaccagaggaaaaatttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataacatttatgttgacctttaatgattgtcgtatgcatactaccatacctactgtttgcattgcaaataagaagggtgcgggtcttcctagtttttcaaaggttaagaaattcttttggtttttgtgtctgttcatagttgctgctttctttgcactaagctttcttgattttagtactcaggttagcagtgatagcgattatgatttcaagtatattgagagtggccagttgaagacttttgacaatccacttagttgtgtgcataatgtctttattaacttcgaccagtggcatgatgccaagtttggtttcacccccgtcaacaatcctagttgtcctatagttgttggtgtatcagacgaagctcgcactgttccaggtatcccagcaggtgtttatttagctggtaaaacacttgtgtttgctattaacaccatttttggtacatctggtttgtgcttcgatgctagtggcgttgctgataagggcgcttgcatttttaattcagcttgcaccacattatctggtttgggtggaactgctgtctactgttacaagaatgggctagttgaaggtgccaaactttatagtgagttggcacctcatagctactataaaatggtagatggtaatgctgtgtctttacctgaaattatttcacgcggctttggcatccgtactatccgtacaaaggctatgacttattgccgtgttggccagtgtgtgcagtctgcagaaggcgtttgttttggcgccgatagattctttgtctataatgcagaatctggttctgactttgtttgtggcacagggctcttcacattgttgatgaacgttattagtgttttttccaagacagtaccagtaactgtgttgtctggtcaaatactttttaattgcattattgcttttgttgctgttgcggtgtgtttcttatttacaaagtttaagcgcatgttcggtgatatgtctgttggcgttttcactgtcggtgcttgtactttgttgaacaatgtttcttacattgtaacacagaacacacttggcatgttgggctatgcaattttgtatttcttgtgcactaagggtgttagatatatgtggatttggcacttgggatttttgatctcatatattcttattgcaccatggtgggttttgatggtttatgccttttcagccatttttgagtttatgcctaacctttttaagcttaaggtttcaacacaactttttgagggcgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcataacgatacgttatacacaccacccactgtgagttacaattcaactctacaggctggcttgcgtaagatggcacaaccttctggtgttgttgagaagtgcatagtccgtgtttgctatggtaatatggctcttaatggcctatggcttggcgatattgttatgtgcccacgccatgttatagcgtctagtactactagcactatagattatgattatgccctttctgttttacgcctccacaacttctccatttcatctgggaatgttttcctaggtgttgtgagtgcaactatgcgaggtgctttgttgcagataaaggttaatcaaaacaatgtccacacgcctaagtacacctatcgcacagttagaccgggtgaatcttttaatattttggcgtgctatgatggtgctgcagctggtgtttacggcgttagcatgcgctctaattacactattagaggctcgttcattaatggcgcttgtggttcacctggttataatattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggatcgctgtagacaggtttaatgagtgggctgttcataatggtatgacaacagtgggcaatactgattgcttttctattcttgctgctaagactggagttgatgtacaacgtttgttggcctcaatccagtctctgcataagaattttggtggaaagcaaattcttggccatacctcgttgacagatgagtttactacaggtgaagttgtacgtcaaatgtatggcgttaatcttcagggtggctatgtgtcacgcgcctgcagaaatgtcttgctggttggttcttttctgactttcttttggtcagaattagtttcctacactaagttcttctgggtaaatcctggttatgttacacctatgtttgcgtgtttgtcattgctatcctcacttttgatgttcacactcaagcataagacattgtttttccaggtcttcttaatacctgctctgattgttacatcttgcattaatttggcatttgatgttgaagtctacaactatttggcagagcattttgattaccatgtttcccttatgggttttaatgcacaaggtcttgttaacatctttgtctgctttgttgttaccattttacacggcacatacacatggcgcttctttaatacacctgcgagttctgtcacttatgtggtagctttgctgactgcggcctataactatttttacgctagtgacattcttagttgtgctatgacactatttgctagtgtgactggcaactggttcgttggtgctgtttgttataaagttgctgtgtatatggccttgagatttcctacgttcgtggctatttttggtgatattaagagtgttatgttctgttaccttgtgttgggttattttacctgttgcttctacggtattctctactggttcaacaggttctttaaggttagtgtaggtgtctatgactatactgttagtgctgctgagtttaagtatatggttgctaatggcctacctgcaccaactggaacacttgattcactactgttgtccgccaaattgattggtattggtggtgagcggaatattaagatttcttccgttcagtctaaactgactgatattaagtgtagtaacgttgtgcttttaggctgtctttctagcatgaatgtttcagcaaattcaacagaatgggcttattgtgttgacttgcataacaagatcaacttgtgtaatgacccagaaaaagcgcaggaaatgctacttgctttgttggcatttttccttagtaagaatagtgcctttggtttagacgacttattggaatcttattttaatgacaatagtatgttgcagagtgttgcatctacttatgtaggtttgccctcctatgtcatttatgaaaatgcacgccaacagtatgaagatgctgttaataatggttctccacctcagttggttaagcaattgcgccatgctatgaatgtagcaaagagcgaatttgaccgtgaggcttctactcagcgtaagcttgatagaatggcggaacaggctgcagcacagatgtataaagaggcaagggcagttaataggaagtccaaagttgtaagtgctatgcattcactgctttttggtatgttgagacgtttggatatgccttctgtagacaccattctcaacttggcaaaggatggggtggtacctctgtctgtcataccggcagtcagtgctactaagcttaacattgttacctctgatatcgattcttataatcgtacccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgttaagctccagaataatgagattattcctggtaagctgaagcagcgctccattaaggcagaaggagatggcatagttggagaaggtaaggcactttacaataatgagggtggacgtacttttatgtatgctttcatttcagataaaccggacctgcgtgtagttaagtgggagttcgatggtggttgtaacactattgagctagaaccaccacgtaagttcttggtggattctcctaatggtgcacagatcaagtatctctactttgttcgtaaccttaacacgttgcgtaggggtgctgttcttggctacataggtgccactgtacgcttgcaggctggtaaacaaacagaacaggctattaactcttcattgttgacactttgcgctttcgctgtggatcctgctaagacctacatcgatgctgttaaaagtggtcacaaaccagtaggtaactgtgttaagatgttggccaatggttctggtaatggacaagctgttactaatggtgtggaggctagtactaaccaggattcatatggtggtgcttccgtgtgtctatattgtagagcacatgttgagcatccatctatggatggtttttgcagactgaaaggcaagtatgtacaggtgccactaggtacagtggatcctatacgttttgtacttgagaatgacgtttgcaaggtttgtggttgttggctgtctaatggctgcacttgtgacagatccattatgcaaagcactgatatggcttatttaaacgagtacggggctctagtgcagctcgactagagccctgtaatggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggggccatagccgaacacgatttcttcacttggaaggatggtcgtgcaatctatggtaacgtttgtagaaaggatcttaccgagtatactatgatggatctgtgttacgctttacgtaactttgatgaaaacaattgcgatgttcttaagagcattttgattaaggtaggtgcttgtgaggagtcctactttaataataaagtctggtttgaccctgttgaaaatgaagacattcatcgtgtctatgcattgttaggtaccattgttgcacgtgctatgcttaaatgcgttaagttctgtgatgcaatggttgaacaaggtatagttggtgttgtcacattagataatcaggatcttaatggtgatttttatgattttggtgattttacttgtagtatcaagggaatgggtgtacccatttgcacatcatattactcttatatgatgcctgttatgggtatgactaattgccttgctagtgagtgttttgttaagagtgatatatttggtgaggattttaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactaccatacctattacggcatttggacctttgtgtcgcaagtgctggattgatggtgttccactggtaactacagctggttatcattttaaacagttaggtatagtttggaataatgacctcaacttacactctagcaggctctctattaatgaattactccagttttgtagtgatcctgcactgcttatagcatcatcaccagcccttgttgaccagcgtactgtttgcttttcagttgcagcgctaggtacaggtatgactaaccagactgtgaaacctggccatttcaataaggagttttatgacttcttacttgagcaaggtttcttctctgagggctctgagcttactttaaagcacttcttctttgcacagaaggttgatgcagctgttaaggattttgactactataggtataatagacccactgttctggacatctgccaagctcgcgtcgtgtatcaaatagtgcaacgctattttgatatttacgagggtggttgtatcactgctaaagaagtggttgttacaaaccttaacaagagcgcaggctatcctttgaacaagtttggtaaagctggtctttactatgagtctttatcctatgaggaacaggatgaactttatgcttatactaagcgtaacatcctgcccactatgacacagctcaaccttaaatacgctattagtggcaaagaacgtgcacgcacagtgggtggtgtctcgcttttgtcaaccatgaccactcggcagtatcatcagaaacaccttaaatccatagttaatactaggggcgcttcggttgttattggtactactaagttttatggtggttgggacaatatgcttaagaaccttattgatggtgttgaaaatccgtgtcttatgggttgggattacccaaagtgcgatagagcactgcccaatatgatacgcatgatttcagccatgatcttaggctctaagcacaccacatgctgcagttctactgaccgctttttcaggttgtgcaatgaattggctcaagtccttactgaggttgtttattctaatggagggttttatttgaagccaggtggtactacctctggtgatgcaaccaccgcatatgcaaactcagttttcaatatcttccaagcagtaagtgccaatgttaacaaacttcttagtgttgacagcaatgtctgtcataacttagaagttaagcaattacaacgtaagctctatgagtgctgttatagatcgactatcgtcgatgaccagttcgtcgttgagtattatggttacttgcgtaaacatttttcaatgatgattctttctgatgatggcgttgtttgttataacaatgactatgcatcacttggttatgtcgcggatcttaacgcattcaaggctgttttgtattaccagaacaacgtcttcatgagcgcctctaaatgttggatcgagcctgacattaataaaggtcctcatgaattttgttcgcagcatactatgcagattgtcgataaggagggtacttattaccttccttaccctgatccttcaagaatcctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtataaaactttgaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaaccaagctctacttaggtggtcttagttactggtgtcatgaacacaagccacgtcttgcattcccgttgtgctctgctggtaatgtttttggcttatacaaaaattctgctaccggttcacccgatgttgaagactttaatcgcattgctacatccgattggactgatgtttctgactacaggttggcaaatgatgtcaaggactcattgcgtctatttgcagcggaaactatcaaggccaaggaggagagcgttaagtcatcctatgcttgtgcaacactacatgaggttgcaggacctaaagagttgttgctcaaatgggaagtcggcagacccaaaccacctcttaatagaaattcggttttcacttgttatcatataacgaagaacaccaaatttcaaatcggtgagtttgtgtttgagaaggcagaatatgataatgacgctgtaacatataaaactaccgccacaacaaaacttgttcctggcatggtttttgtgcttacctcacataatgttcagccattgcgtgcaccaaccattgctaatcaagaacgttattccactatacataagttgcatcctgcttttaacatacctgaagcttattctagcttagtgccctattaccaattgattggtaagcagaagattacaactatccagggaccccccggtagtggtaaatctcactgtgttatagggctaggtttgtactatccaggtgcacgtattgtgtttacagcttgttctcatgcagcggtcgattcactctgtgtgaaggcctccactgcttatagcaatgacaaatgttcacgcatcataccacagcgtgctcgtgttgagtgttatgatggtttcaagtctaataatactagtgctcagtaccttttctccactgtcaatgctttgccagagtgtaatgcggacattgttgtggtggatgaagtttctatgtgcactaattatgacttgtctgtcataaatcagcgcatcagctataggcatgtagtctatgttggtgaccctcaacagctgcctgcaccacgtgttatgatttcacgtggtactttggaaccaaaggactacaatgttgtcactcaacgtatgtgtgcccttaagcctgatgtcttcttgcacaagtgttatcgctgtcctgcagagatagtgcgcactgtgtctgagatggtctatgaaaaccaattcattcctgtgcaccctgacagcaagcagtgttttaagatcttttgcaagggtaatgtgcaggttgataacggttcaagtattaaccgtaggcaattggatgttgtgcgtatgtttttggctaaaaatcctaggtggtcaaaggctgttttcatttccccttataacagccagaattatgttgccagccgtttgctaggtttacaaattcagacagttgattcatcccagggtagtgagtatgactatgtcatttacgcacaaacctcagatactgcccatgccagtaatgttaacaggtttaatgttgccatcacaagggctaagaaaggcatattatgtataatgtgcgataggtccctttttgatctgcttaaattttttgagcttaaattgtctgatttgcaggctaatgagggttgtggtctttttaaagactgtagcagaggtgatgatttgttgccaccgtctcatgctaataccttcatgtctttagcggacaattttaagactgatcaatatcttgctgttcaaataggtgttaatggacccattaaatatgagcatgttatctcgtttatgggtttccgttttgatattaacatacccaaccaccacactctcttttgcacacgcgactttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactacattaaacccgtcagagctcgtgctccaccaggggaacaattcgcacaccttttgcctttacttaaacgcggccaaccatgggatgtggttcgcaagcgtatagttcaaatgtgtagtgactacctggctaacctatcagacatactaatttttgtgttgtgggctggtggtttggagttgacaactatgcgttacattgtcaagattggaccaagcaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgcattgtgcaatcacgcactatgcgttcagttcttaagttatacaatccaaaagccatatatgatattggcaatcctaagggcattagatgcgccgtaacggatgctaagtggttctgctttgacaagaatcctactaattctaatgtcaagacattggagtatgactatataacacacggccaatttgatgagttgtgcttgttttggaattgcaatgtggacatgtatccagaattttctgtggtctgtcgttttgatactcgctgtaggtcaccactcaacttggagggttgtaatggtggttcactgtatgttaacaatcatgcattccacacaccggcttttgacaagcgtgcttttgctaagttgaagccaatgccatttttcttctatgatgatactgagtgtgacaagttacaggactccataaactatgttcctcttagggctagtaactgcattactaaatgtaatgttggtggagctgtttgtagtaagcattgtgctatgtatcatagctatgtcaatgcttacaacacctttacgtcagcgggctttacgatttgggtgcccacttcgtttgacacctataatctgtggcagacatttagtaacaatttacaaggtcttgagaacattgctttcaatgttttaaagaaaggatcttttgttggtgatgaaggtgagcttcctgtagctgtggtcaatgacaaagtgctcgttagagatggtactgttgatactcttgtttttacaaacaagacatcactacccactaacgtagcttttgagttgtatgccaagcgtaaggtaggactcacccctcccattacgatcctacgtaacttgggtgttgtttgtacatctaagtgtgtcatttgggactatgaagccgaacgtccacttactacttttacaaaggatgtctgtaaatataccgactttgagggtgacgtttgtacactctttgataacagcattgttggttcattagagcgattctctatgacccagaatgctgtgcttatgtcacttacagctgttaaaaagcttactggcataaagttaacttatggctatcttaatggtgtcccagttaacacacatgaagataaaccttttacttggtatatttacactaggaagaacggcaagttcgaggactatcctgatagctattttacccaaggtagaacaaccgctgattttagccctcgtagcgacatggaaaaggacttcctaagtatggatatgggtttgtttattaacaagtacggacttgaagattacggctttgagcacgttgtgtatggtgatgtttcaaaaaccacccttggtggtttacatctactaatttcgcaggtgcgtctggcctgtatgggtgtgcttaaaatagacgagtttgtgtctagtaatgatagcacgttaaagtcatgtactgttacatatgctgacaaccctagtagtaagatggtttgcacgtatatggatctcctgcttgacgattttgttagcattcttaaatctttggatttgagcgttgtatctaaggttcatgaagttatggttgattgtaaaatgtggaggtggatgttgtggtgtaaggatcataaactccagacattttatccacaacttcaagccagtgaatggaagtgtggttattccatgccttctatttacaagatacaacgtatgtgcttagaaccttgcaatctctataactatggtgctggtgttaagttacctgatggcattatgtttaacgtagttaaatacacacagctttgtcaatatctcaatagcaccacaatgtgtgtaccccatcacatgcgtgtgctacatcttggtgctggctccgataagggtgttgcacctggcacggctgtcttacgacgttggttgccactggatgccattatagttgacaatgatagtgtggattacgttagcgatgctgattatagtgttacaggagattgctctaccttatacctgtcagataagtttgacttagttatatctgatatgtatgatggtaagattaaaagttgtgatggggagaacgtgtctaaagaaggcttctttccctatattaatggtgttatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacaccatgcatgccaattatatcttctggcgtaattccacaattatgactatgtcttacaacagtgtgcttgatttaagcaagttcaattgtaagcataaggctacagttgttgttaatttaaaagactcatccattagtgatgttgtgttaggcttgttgaagaatggtaagttgctagtgcgtaataatgacgccatttgtggcttttctaatcatttggtcaacgtaaacaaatgaggtctttaatttacttctggttgctcttaccagtacttccaacactcagcctaccacaagatgtcactaggtgccagtctactactaactttaggcggttcttttcaaaatttaatgttcaggcacctgccgtcgtcgttttgggtggttacctacctagtatgaactcttctagctggtactgtggcacaggcattgaaactgctagtggcgttcatggtatttttctcagctacatcgattctagtcagggctttgagattggcatttcgcaagagccgtttgatcctagtggttaccagctttatttacataaggccactaatgagagtcagaatggtaacactaatgctattgcacgactgcgcatttgccagtttcccgataataaaacattgggccctactgttaatgatgttacaacaggtcgtaactgcctattcaacaaagccattccagcttatatgcgtgatggaaaagatattgttgtcggcataacatgggataatgatcgtgtcactgtttttgctgacaagatctatcatttttatcttaaaaatgattggtcccgcgttgcgacaagatgttacaatcgcagaagttgtgctatgcaatatgtttatacacctacctactacatgcttaatgttactagtgcaggtgaggatggcatttattatgaaccctgtacagctaattgcactggttacgctgccaatgtatttgccactgattccaatggccatataccagaatgttttagttttaataattggtttcttttatccaatgactccactttgttgcatggtaaagtggtttccaaccaacccttgttggtcaattgtcttttggccattcctaagatttatggactaggccaatttttctcattcaatcacacgatggatggcgtttgtaatggagctgctgtggatcgtgccccagaggctctgaggtttaatattaatgacacctccgtcattcttgctgaaggctcaattgtacttcatactgctttaggaacaaatctttcttttgtttgcagtaattcctcagatcctcatttagccatctttgccatacctctgggtgctactgaagtaccctactattgctttcttaaagtggatacttacaactccactgtttataaattcttggctgttttacctcctactgtcagggaaattgtcatcaccaagtatggtgatgtttatgtcaatgggtttggctatttgcatctcggtttgttggatgctgtcacaattaatttcactggtcatggcactgacgatgacgtttcaggtttctggaccatagcatcgactaattttgttgatgcactcatcgaggttcaaggaacttccattcagcgtattctttattgtgatgatcctgttagccaactcaagtgttctcaggttgcttttgaccttgacgatggtttttaccccatctcttctagaaaccttctgagtcacgaacagccaatttcttttgttactttgccattatttaatgatcattcttttgttaatattactgtctctgcggcttttggtggtcttagtagtgccaatctcgttgcatctgacactactatcaatgggtttagttctttctgtgttgacactagacaatttaccattacactgttttataatgttacaaacagttatggttatgtgtctaaatcacaggatagtaattgtcctttcaccttgcaatctgttaatgattacctgtcttttagcaaattttgtgtttcaaccagccttttggctggtgcttgtaccatagatctttttggttaccctgcgttcggtagtggtgttaagttgacgtccctttattttcaattcacaaaaggtgagttgattactggcacgcctaaaccacttgaaggtatcacagacgtttcttttatgactctggatgtgtgtaccaagtatactatctatggctttaaaggtgagggtattattacccttacaaattctagcattttggcaggtgtttattatacatctgattctggacagttgttagcctttaagaatgtcactagtggtgctgtttattctgtcacgccatgttctttttcagagcaggctgcatatgttaatgatgatatagtgggtgttatttctagtttgtctaactccacttttagcaatactagggagttgcctggtttcttctaccattctaatgacggctccaattgtacagagcctgtgttggtgtatagtaacataggtgtttgtaaatctggcagtattggctatgttccacctcagtatggccaagtcaagattgcacccacggttactgggaatattagtattcccaccaactttagtatgagtattagaacagaatatttacagctttacaacacgcttgttagtgttgattgtgctacatatgtttgtaatggtaactctcgttgtaaacaattactcacccagtacactgcagcatgtaagaccatagagtcagcattacaactcagcgctaggcttgagtctgttgaagttaactctatgcttaccatttctgaagaggctttacagttagctaccatcagttcgtttaatggtgatggatataactttactaatgtgctgggtgcttccgtgtacgatcctgcaagtggcagggtggtacaaaaaaggtctgttattgaagacttgctttttaataaagtggttactaatggccttggtactgttgatgaagactataagcgctgttctaatggtcgctctgtggctgatctagtctgtgcgcagtattactctggtgtcatggtactacctggcgttgttgacgctgagaagcttcacatgtacagtgcgtctctcataggtggtatggcgctaggaggtataactgctgcaacggcattgccttttagctatgctgttcaagcgagactcaattatcttgctttacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaattcgcagggttcagctttgaaccaacttaccgtacagctgcaacacaacttccaagccatttctagttctattgatgacatttattcccgactggacattctttcagccgatgttcaggttgatcgtctcatcaacggcagattatcagcacttaatgcttttgttgcccaaaccctcactaagtatactgaggttcaggctagcaggaagctagcacagcaaaaggttaatgagtgcgtcaaatcgcaatctcagcgttacggtttttgtggtggtgatggcgagcacattttctctctggtacaggccgcacctcagggcctgctgttcttacatacagtacttgtaccgggtgattttgtaaatgttcttgccatcgctggcttatgcgttaatggtgaaattgccttgactctacgcgagcctggcttagtcttgtttacgcatgaacttcaaaattatactgcgacggaatattttgtttcatcgcgacgtatgtttgaacctagaaaacctaccgttagtgattttgttcaaattgagagttgtgtggtcacctatgtcaatctgactagcgaccagctaccagatgtaatcccagattacatcgatgttaacaaaacacttgatgagattttagcttctctgcccaatagaaatggtccaagtctttccctagatgtttttaatgccacttatcctaatcttactggtgaaattgcagatctagagcagcgttcagagtctctccgtaatactacagaagagctccgaagtctcattaacaacatcaacaacacacttgttgaccttgagtggctcaaccgagttgagacatacatcaagtggccgtggtgggtttggttgatcattgttattgttctcatctttgttgtgtcattactagtgttctgctgcatttccacgggttgttgtggatgctgcggttgctgcggtgcttgtttttcaggttgttgtaggggtcctagacttcaaccttacgaagcttgacacagttgtcaaagatgtctcgaagtctgttaacttgtctttggatgctgtccaagagttggagctcaatgtagttccaattagacaagcttcaaatgtgacgggttttcttttcaccagtgtttttgtttacttctttgcactgtttaaagcgtcttctttgaggcgcaattatattatgttggcagcgcgttttgctgtcgtctttctctattgcccacttttatattactgtggtgcacttttagatgcaactattatttgttgcgcacttattggcaggctttgtttagtctgcttttactcctggcgctataaaaatgcgctttttattatctttaatactacgacactttcttttctcaatggtaaagcagcttattatgacggcaaatccattgtgattctagaaggtggcgaccattacatcacttttggcaactcttttgttgctttcgttagtaacattgacttgtatctagctatacgtgggcggcaagaagctgacctacatctgttgcgaactgttgagcttcttgatggcaagaagctttgtgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattaccttcgtccaattgtttaatctgtgcttcacttgtcaccggttgtgtaatagcgcagtttatacacctatagggcgcctgtatagagtttataagtcttacatgcgaattgaccccctccccagtactgttattcacgtataaacgaaatatgtctaacggttctattcccgttgatgaggtgattatgctagtacttgaacaccttagaaactggaatttcacatggaatatcatactgacgatactacttgtagtgcttcagtatggccattacaagtactctgtgttcttgtatggtgtcaagatggctattctatggatactttggcctcttgtgttggcactgtcactttttgatgcatgggctagcttccaggtcaactgggtctttttcgctttcagcatccttatggcttgcatcactcttatgctgtggataatgtattttgtcaatagcattcggttgtggcgcaggacacattcttggtggtctttcaatcctgaaactgacgcgcttctcactacttctgtgatgggccgacaggtccgcattccagtgcttggagcaccaactggtgtaacgctaacactccttagtggtacattgtttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtcaaaacacggcgactattcagctgtgagtaatccgagtgcggttctcacagatagtgagaaagtgcttcatttagtctaaacagaaactttatggcttctgtcagctttcaggatcgtggccgcaaacgggtgccattatctctctatgcccctcttagggttactaatgacaagcccctttctaaggtacttgcaaacaacgctgtacccactaacaaggggaataaggaccagcaaattgggtactggaatgagcaaattcgctggcgcatgcgccgtggtgagcgaattgaacaaccttccaattggcatttctactacctcggaacaggacctcacggcgacctccgttataggactcgtactgagggtgttttctgggttgctaaagaaggcgcaaagactgaacccactaatttgggtgtcagaaaggcgtctgaaaagccaatcattccaaaattctctcaacagctccccattgtagttgagattgttgaacctaacacacctcctgcttcacgtgcaaattcgcgtagcaggagtcgtggcaatggcaacaataggtctagatctccaagtaacaacagaggcaataaccagtcccgtggtaattcgcagaatcgtggaaataaccagggtcgtggagcttctcagaacagaggaggcaataataataacaataacaagtctcgtaaccagtccaataacaggaaccagtcaaatgaccgtggtggtgtaacatcacgcgatgatctggtggctgctgtcaaggatgcacttaaatctttgggtattggagaaaatcctgacaggcataagcaacagcagaagcctaagcaggaaaagtctgacaacagcggcaaaaatacacctaagaagaacaaatccagggccacttcgaaggaacgtgacctcaaagacatcccagagtggaggagaattcccaagggcgaaaatagcgtagcagcttgcttcggacccagagggggcttcaaaaactttggagatgcggaatttgtcgaaaaaggtgttgatgcgtcaggctatgctcagatcgccagtttagcaccaaatgttgcagcattgctctttggtggtaatgtggctgttcgtgagctagcggactcttacgagattacatacaactataaaatgactgtgccaaagtcagatccaaatgttgagcttcttgtttcacaggtggatgcatttaaaactgggaatgcaaaactccagagaaagaaggaaaagaagaacaagcgtgaaaccacgctgcagcagcatgaagaggccatctacgatgatgtgggtgcgccatctgatgtgacccatgccaatctggaatgggacacagctgttgatggtggtgatacggccgttgaaattatcaacgagatcttcgatacaggaaattaaacaatgttagaccggcttatcctggctatgttccagggtagtgccattacactgttattactgagtgtttttctagcgacttggctgctgggctatggctttgccctctaaccagcggtcttggtcttgcacataacggtaagccagtggtaatgtcagtgcaagaaggatattaccatagcactgtcacgaggggaacgcagtaccttttcatctaaacctttgcacgagtaattaaagatccgcttgacgagcctatatggaagagcgtgccaggtatttgacttaaggactgttagtaactgaagacctgacggtgttgatatggatacac

SEQ ID NO: 8 - DNA, 27931 bp, porcine epidemic diarrhea virus
acttaaagagattttctatctatggatagttagctctttttctagattcttgtctactcaattcaactaaacgaaattttgtccttccggccgcatgttcatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgtcacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccagaaacatttgtggttggctgttattttctaactgtaattacttcctcgaagagttagagctcacttttggtcgtcgtggtggtaacatcgtgccagttgaccaatacatgtgtggcgctgacgggaaacctgttcttcaggaatccgagtgggagtatacagatttctttgctgactccgaagacggtcaactcaatattgctgggatcacttatgtgaaggcctggattgtagatcgatcggacgtctcttatgcgagtcagaatttaacatctattaagtctattacttactgttcaacctatgagcatacttttcctgatggtactgccatgaaggttgcacgtactccaaagatcaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcytatgtctccacctgctgtggctttaagtgcaagccagtccttgtggcctcatgctctgctacgcctggttctgttgtggttacacgcgctggtgctggcactggtgttaagtactacaacaacatgttcctgcgccatgtggcagacattgatggattggcattctggcgaattcttaaggtgcagtccaaagacgacctcgcttgctctggtaaattccttgaacaccatgaggaaggtttcacagacccttgctactttttgaatgactcgagccttgctactaagctcaagtttgacatccttagtggcaagttttctgatgaagtcaaacaagctatctttgctggtcatgttgttgttggcagtgcgctcgttgacattgttgacgatgcactgggacaaccttggtttatacgtaagcttggtgaccttgcaagtgcagcttgggagcagcttaaggctgtcgttagaggccttaacctcttgtctgatgaggttgtgctctttggcaaaagacttagctgtgccactcttagtatcgttaacggtgtttttgagtttctcgccgatgtgccagagaagttggctgtggctgttacagtttttgtcaacttcttgaatgagctctttgagtctgcctgtgactgcttaaaggtcggaggtaagaccttcaacaaggttggctcttatgttctttttgacaatgcattggttaagcttttcaaggcaaaagttcgcggcccacgacaggcaggtatttgtgaagttcgttacacaagcctggttattgggagtactaccaaggtggtttccaagcgcgttgaaaatgccaatgtgaatctcgtcgtcgttgatgaggatgtgaccctcaacaccactggtcgtacagttgttgttgatggacttgcattcttcgagagtgacgggttttacagacatcttgctgatgctgacgttgtcattgaacatcctgtttataagtctgcttgtgagctcaagccagtttttgattgtgacccaatacctgattttcctatgcctgtggccgctagtgttgcagagctttgtgtgcaaactgatctgttgcttaaaaattacaacactccttataaaacttacagctgcgtggtgagaggtgataagtgttgcatcacttgcaccttacatttcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagatattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgtcttccagattcctgtccaggcaggcattgagaagtttagagttttccttaattgtgttcaccctgttgtaccacgtgtcattgaaacttcttttgtggaattagaagagacgacatttaaaccaccagcactcaatggtagtattgctattgttgatggcttcgctttctattatgatggaacactatactatcccaccgatggtaatagtgttgtgcctatctgttttaagaagaaaggtggtggtgatgtcaaattctctgatgaagtctctgttaaaaccattgacccagtttataaggtctcccttgaatttgagttcgagtctgagactattatggctgtgcttaataaggctgttggtaatcgtatcaaggttacaggtggttgggatgatgttgttgagtatatcaacgttgccattgaggttcttaaagatcacattgaggtgcctaagtactacatctatgatgaggaaggtggcaccgatcctaatctgcccgtaatggtttctcagtggccgttgaatgatgacacgatctcacaggacctgctcgatgtggaagttgttacggatgcaccaattgattccgagggtgatgaagtagactcctctgaacctgagaaggtggcagatgtggctaactctgaaactgaggctgatgatgtagagtctgaagttgaggaagttgccgcaactttgtcctttattaaagatacaccttccacagttactaaggatccttttgcttttgactttgtaagctatggaggacttaaagttttaagacaatctcataacaactgttgggttacttctaccttggtgcagctacaattgcttggcatcgttgatgaccctgcaatggagctttttagtgctggtagagttggtccaatggttcgcaaatgctatgagtcacaaaaggctattttgggatctttgggtgatgtgtcggcttgcctagagtctttgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgccgagatactactgttatctccttggattctttggttgtaaaacctctttgtgcggctgcttttataggcaaggatagtggtcattatgtcaccaacttttatgatgctgctatggctattgatggttatggtcgtcatcagataaagtatgacacactgaacaccatttgtgttaaagacgtgaattggacagcaccttttgtccctgacgttgagcctgtattggagcctgttgtcaaaccattctattcttataagaatgttgatttttaccaaggagattttaatgaccttgttagacttccatgtgactttgttgttaatgctgcaaatgagaatttgtctcatggtggcggcatagcaaaggccattgatgtttataccaagggcatgttgcagaagtgctcaaatgattatattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagaggtgcttgttgacactattcctgtccaggaagatgttcaacaagtttcacaagaaccagttttgcctaattttgaacctttcaggatcgaaggcgctcatgctttctatgagtgcaaccctgaaggtttgaactccttaggtgctgacaagctggtgttgtttacaaattccaatttggatttttgtagcgttggtaagtgtcttaacaatgtgaccggcggtgcattgcttgaagccataaatgtatttaaaaagagtaacaaaacagtgcctgctggcaactgtgttacttttgagtgtgcagatatggtttctattactatggtagtattgccatctgatggtgatgctaattatgacaaaaattatgcacgcgccgttgtcaaggtatctaagcttaaaggcaagttagtgcttgctgttggtgatgccacgttgtattccaagttgtcccacctcagcgtgttaggtttcgtatccacacctgacgatgtggagcgtttctacgcaaataagagtgtggttattaaagttactgaggatacacgtagtgttaaggctgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgtcacatgtttacaattacagtttgctagatttaggttcaagtcagcaggtttacaggctatgtgggagtcctattgtactggtgatgttgctatgtttgtgcattggttgtactggcttactggtgttgacaaaggtcagcctagtgattcagaaaatgcacttaacatgttgtccaagtacattgttcctgctggttctgtcactattgaacgtgtcacgcatgacggctgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcacacctctttcttaagggtgtttcctacacaacattcctagataatggtaacggtgttgtcggccattatactgtttttgatcatggcactggtatggtgcatgatggagatgcttttgtaccgggtgatcttaatgtatcccctgttacaaatgttgttgtctcagagcagacggctgttgtgattaaagaccctgtgaagaaagtagagttagacgctacaaagctgctagacactatgaattatgcatcggaaagattctttttctttggtgatttcatgtcacgtaatttaattacagtgtttttgtacatccttagcattttgggtctctgttttagggcctttcgtaagggggatgttaaagttctagctggtgtaccccaacgtactggtattatattgcgtaaaagtgtgcgctataatgcaaaggcgttgggtgtctttttcaagctaaagctttattggttcaaagttcttggtaagtttagtttgggtatttatgcattgtatgcattactattcatgacaatacgctttacacctataggtagccctgtttgtgatgatgttgttgctggttatgctaattctagttttgacaagaatgagtattgcaacagtgttatttgtaaggtctgtctctatgggtaccaggaactctcggacttctcccatacacaggtagtatggcaacaccttagagacccattaattggtaatgtgatgcctttcttttatttggcatttctggcaatttttgggggtgtctatgtaaaggctattactctctattttattttccagtaccttaacactcttggtgtgtttttgggcctacaacagtccatttggtttttgcagcttgtgccttttgatgtctttggcgacgagatcgtcgtctttttcatcgttacacgcgtattgatgttccttaagcatgttttccttggctgcgataaggtatcttgtgtggcttgctctaagagtgctcgccttaagcgcgttcctgtccagactatctttcagggtactagcaaatccttctacgtacatgccaatggtggttctaagttttgtaagaagcacaatttcttttgtttaaattgtgattcttatggtccaggctgcacttttattaacgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagatagcaaatacacttgcaaagaggcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggygcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgctatgatgtcctcttgactgacatgtcattcaacaattttaccaccagttatgcaaaaccagaggaaaaatttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataacatttatgttgacctttaatgattgtcgtatgcatactaccatacctactgtttgcattgcaaataagaagggtgcaggtcttcctagtttttcaaaggttaagaaattcttttggtttttgtgtctgttcatagttgctgttttctttgcactaagctttcttgattttagtattcaggttagcagtgatagcgattatgatttcaagtatattgagagtggccagttgaagacttttgacaatccacttagttgtgtgcataatgtctttagtaacttcgaacagtggcatgatgccaagtttggtttcacccccgtcaacaatcctagttgtcctatagtcgttggtgtatcagacgaagctcgcactgttccaggtatcccagcaggtgtttatttagctggtaaaacacttgtgtttgctattaacaccatttttggtacatctggtttgtgctttgatgctagtggcgttgctgataagggcgcttgcatttttaattcggcttgcaccacattatctggtttgggtggaactgctgtctactgttacaagaatgggctagttgaaggtgccaaactttatagtgagttggcacctcatagctactataaaatggtagatggtaatgctgtgtctttacctgaaattatttcacgtggctttggcatccgtactattcgtacaaaggctatgacttattgccgtgttggccagtgtgtgcagtctgcagaaggcgtttgttttggcgccgatagattctttgtctataatgcagaatctggttctgactttgtttgtggcacagggctcttcacattgttgatgaacgttattagtgttttttccatgacagtaccagtaactgtgttgtctggtcaaatactttttaattgcattattgcttttgctgctgttgcggtgtgtttcttatttacaaagtttaagcgcatgttcggtgatatgtctgttggcgttttcactgttggtgcttgtactttgttgaacaatgtttcttacattgtaacacagaacacacttggcatgttgggctatgtaactttgtacttcttgtgcactaagggtgttagatatatgtggatttggcacttgggatttttgatctcatatattcttattgcaccatggtgggttttgatggtttatgccttttcagccatttttgagtttatgcctaacctttttaagcttaaggtttcgacacaactttttgagggcgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcataacgatatgttatacacaccacccactgtgagttataattcaactctacaggctggcttgcgtaagatggcacaaccctctggtgttgttgagaagtgcatagtccgtgtttgctatggtaatatggctctcaatggtctatggcttggtgatactgttatgtgcccacgccatgttatagcgtctagtactactagcactatagattatgattatgccctttctgttttacgcctccataacttctccatttcatctgggaatgttttcctaggtgttgtgagtgcaaccatgcgaggtgctttgttgcagataaaggttaatcaaaacaatgtccacacgcctaagtacacccatcgcacagttagaccgggtgaatcttttaatattttggcttgttatgatggtgctgcagctggtgtttacggcgttaacatgcgctctaattacactattagaggctcgttcattaatggcgcttgtggttcacctggttataatattaacaatggtaccgttgagttttgctatttacaccagcttgaacttggttcaggctgtcatgttggtagcgacttagatggtgttatgtatggtggttatgaggaccaacctattttgcaagttgaaggcgctagtagtctgtttacagagaatgtgttggcatttctttatgcagcactcattaatggttctacctggtggcttagttcttctaggatcgctgtagacaggtttaatgagtgggctgttcataatggtatgacaacagtgggcaatactgattgcttttctattcttgctgctaagacaggcgttgatgtacaacgtttgttggcctcaatccagtccctgcataagaattttggtggaaagcaaattcttggctatacctcgttgacagatgagtttactacaggtgaagttatacgtcaaatgtatggcgttaatcttcagggtggttatgtttcacgcgcctgcagaaatgtcttgctggttggttcttttctgactttcttttggtcagaactagtttcctacactaagttcttttgggtaaatcctggttatgttacacctatgtttgcgtgtttgtcattgctgtcctcacttttgatgttcacactcaagcataagacattgtttttccaggtcttcttaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaatacaactgtgagttctgtcacctatgtggtagctttgctgactgcggcatataactatttttatgctagtgacattcttagttgtgctatgacactatttgctagtgtgactggcaactggttcgtcggtgctgtttgttataaagctgctgtgtatatggccttgagatttcctacgtttgtggctatttttggtgatattaagagtgttatgttttgttaccttgtgttaggttattttacctgttgcttctatggtattctctactggttcaacaggttctttaaggttagtgtaggtgtctatgactatactgttagtgctgctgagtttaagtatatggttgctaatggcctacgtgcaccaactggaacacttgattcgctactgctgtctgccaaattgattggtattggtggtgagcggaatattaagatttcttccgttcagtctaaactgactgatattaagtgtagtaacgttgtgcttttaggctgtctttctagcatgaatgtctcagcaaattcaacagaatgggcttattgtgttgacttgcataacaagatcaacttgtgtaatgacccagaaaaagcgcaggaaatgctacttgctttgttggcatttttccttagtaagaatagtgcctttggtttagacgacttattggaatcttattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgctatgaatgtagcaaagagcgaatttgaccgtgaggcttctactcagcgtaagcttgatagaatggcggaacaggctgcagcacagatgtacaaagaggcaagggcagttaataggaagtccaaagttgtaagtgctatgcattcactgctttttggtatgttgagacgtttggatatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgcgggtaccatttggaatataattgatatcaaggacaatgatggcaaggtggtacacgttaaggaggtaaccgcacagaatgctgagtccctgtcatggcccctggtccttgggtgtgagcgtattgttaagctccagaataatgaaattattcctggtaagctgaagcagcgctccattaaggcagaaggagatggcatagttggagaaggtaaggcactttataataatgagggtggacgtacttttatgtatgctttcatttcagataaaccggacctgcgtgtagttaagtgggagttcgatggtggttgtaacactattgagctggaaccaccacgtaagttcttggttgattctcctaatggtgcacagatcaagtatctctactttgttcgtaaccttaacacgttgcgtaggggtgctgttcttggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcttccgtgtgtctatattgtagagcacatgttgagcatccatctatggatggtttttgcagactgaaaggcaagtacgtacaggtgccactaggtacagtggatcctatacgttttgtacttgagaatgacgtttgcaaggtttgtggttgttggctggctaatggctgcacttgtgacagatccattatgcaaagtactgatatggcttatttaaacgagtacggggctctagtgcagctcgactagagccctgtaacggtaccgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtactaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatctgtgttacgctttacgtaactttgatgaaaacaattgcgatgttcttaagagcattttgattaaggtaggtgcttgtgaggagtcctacttcaataataaagtctggtttgaccctgtcgaaaatgaagacattcatcgtgtctatgcattgttaggtaccattgttgcacgtgctatgcttaaatgcgttaagttctgtgatgcaatggttgaacaaggtatagttggtgttgtcacattagataatcaggatcttaatggtgatttttatgattttggtgattttacttgtagtatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataaggcagtactcttcaacaagtatttcaagtattggggactgcaataccaccctaattgtgtggactgcagtgatgagcagtgcatagttcactgtgccaacttcaatacgttgttttccactaccatacctattacggcatttggacctttgtgtcgcaagtgctggattgatggtgttccactggtaactacagctggttatcattttaaacagttaggtatagtttggaataatgacctcaacttacactctagcaggctctctattaatgaactactccagttttgtagtgatcctgcactgcttatagcatcatcaccagcccttgttgatcagcgtactgtttgcttttcagttgcagcgctaggtacaggtatgactaaccagactgtgaaacctggccatttcaataaggagttttatgacttcttacttgagcaaggtttcttctctgagggctctgagcttactttaaagcacttcttctttgcacagaagggtgatgcagctgttaaggattttgattactataggtataatagacccactgttctggacatctgccaagcacgcgtcgtgtatcaaatagtgcaacgctattttgatatttacgagggtggttgtatcaccgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctattagtggcaaagaacgtgcacgcacagtgggtggtgtctcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggattacccaaagtgcgacagagcactgcccaatatgatacgtatgatttcagccatgatcttaggctctaagcacaccacatgctgcagttctactgaccgctttttcaggttgtgcaatgaattggctcaagtccttactgaggttgtttattctaatgggggtttttatttgaagccaggtggtactacctctggtgatgcaaccaccgcatatgcaaactcagttttcaatatcttccaagcagtaagtgccaatgttaacaaacttcttagtgtcgacagcaatgtctgtcataatttagaagttaagcaattgcaacgtaagctctatgagtgctgttatagatcaactaccgtcgatgaccagttcgtcgttgagtattatggttacttgcgtaaacatttttcaatgatgattctttctgatgatggcgttgtttgttacaacaatgactatgcatcacttggttatgtcgctgatcttaatgcattcaaggctgttttgtattaccagaacaatgtcttcatgagcgcctctaaatgttggattgagcctgacattaataaaggtcctcatgaattttgctcgcagcatactatgcagattgttgataaggatggtacttattaccttccttaccctgatccttcaagaatcctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtataaaacgttgaatgctggtgtgttagagtctttttctgtcacacttttggaagattctactgctaaattctgggatgagagcttttatgccaacatgtatgagaaatctgcagttttacaatctgcagggctttgtgtggtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaaccaagctctatttaggtggtcttagttattggtgtcatgaacacaagccacgtcttgcattcccattgtgctctgctggtaatgtttttggcttatataaaaattctgctaccggctcacccgatgttgaggactttaatcgcattgctacatccgattggactgatgtttctgactacaggttggcaaatgatgtcaaggactcattgcgtctatttgcagcagaaactatcaaggccaaggaggagagcgttaagtcatcctatgcttgtgcaacactacacgaggttgtaggacctaaagagttgttgctcaaatgggaagtcggcagacccaaaccacctcttaatagaaattcggttttcacttgttatcatataacgaagaacaccaaatttcaaatcggtgagtttgtgtttgagaaggcagaatatgataatgacgctgtaacatataaaactaccgccacaacaaaacttgttcctggcatggtttttgtgcttacctcacataatgttcagccattgcgtgcaccaaccattgctaatcaagaacgttattccactatacataagttgcatcctgcttttaacatacctgaagcttattctagcttagtgccctattaccaattgatcggtaagcagaagattacaactatccagggacctcccggtagtggtaaatctcactgtgtcatagggctaggtttgtactatccaggtgcacgtattgtgtttgcagcttgttctcatgcagcggtcgattcactctgtgtgaaggcctccactgcttatagcaatgacaaatgttcacgcatcataccacagcgtgctcgtgttgagtgttatgatggtttcaagtctaataatactagtgctcagtaccttttctccactgtcaatgctttgccagagtgtaatgcggacattgttgtggtggatgaggtctctatgtgcactaattacgacttgtctgtcataaatcagcgcatcagctataggcatgtagtctatgttggtgaccctcaacagctgcctgcaccacgtgttatgatttcacgtggtactttggaaccaaaggactacaatgttgtcactcaacgtatgtgtgcccttaagcctgatgtcttcttgcacaagtgttatcgctgtcctgcagagatagtgcgcactgtgtctgagatggtctatgaaaaccaattcattcctgtgcaccctgacagcaagcagtgttttaagatcttttgcaagggtaatgtgcaggttgataacggttcaagcattaaccgcaggcaattggatgttgtgcgtatgtttttggctaaaaatcctaggtggtcaaaggctgtttttatttctccttataacagccagaattatgttgccagccgtgtgctgggtttacaaattcagacagttgattcatcccagggtagtgagtatgactatgtcatttacacacaaacctcagatactgcccatgcctgtaatgttaacaggtttaatgttgccatcacaagggctaagaaaggcatattatgtataatgtgcgataggtccctttttgatgtgcttaaattctttgagcttaaattgtctgatttgcaagctaatgagggttgtggtctttttaaagactgtagcagaggtgatgatctgttgccaccatctcatgctaataccttcatgtctttagcggacaattttaagactgatcaagatcttgctgttcaaataggtgttaatggacccattaaatatgagcatgttatctcgtttatgggtttccgttttgatattaacatacccaaccatcacactctcttttgcacacgcgattttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactatattaaacccgtcagagctcgtgctccaccaggggaacaattcgcacaccttttgcctctacttaaacgcggtcaaccatgggatgtggttcgtaagcgtatagtgcaaatgtgtagtgactacctggctaacctatcagacatactaatttttgtgttgtgggctggtggtttggagttgacaactatgcgttactttgtcaagattggaccaagcaagagttgtgattgtggtaaggttgctacttgttacaatagtgcgctgcatacgtactgttgtttcaaacatgcccttggttgtgattacctgtataacccatactgtattgatatacagcagtggggatacaaggggtcacttagccttaaccaccatgagcattgtaatgtacatagaaacgagcatgtggcttctggtgatgccataatgactcgttgtctagccatacatgattgctttgtcaagaacgttgactggtccatcacatacccatttattggtaatgaggctgttattaataagagcggccgaattgtgcaatcacacaccatgcggtcagttcttaagttatacaatccgaaagccatatatgatattggcaatcctaagggcatcagatgtgccgtaacggatgctaagtggttttgctttgacaagaatcctactaattctaatgtcaagacattggagtatgactatataacacacggccaatttgatgggttgtgcttgttttggaattgcaatgtggacatgtatccagaattttctgtggtctgtcgttttgatactcgctgtaggtcaccactcaacttggagggttgtaatggtggttcactgtatgttaacaatcatgcattccatacaccggcttttgataagcgtgcttttgctaagttgaagccaatgccatttttcttctatgatgatactgagtgtgacaagttacatgactccataaactatgttcctcttagggctagtaattgcattactaaatgtaatgttggtggagctgtctgtagtaagcattgtgctatgtaccatagctatgttaatgcttacaacacctttacgtcagcgggctttacgatttgggtgcccacttcttttgacacctacaatctgtggcagacatttagtaacaatttgcaaggtcttgagaacattgctttcaatgtcgtaaagaaaggatcttttgttggtgctgaaggtgagcttcctgtagctgtggttaatgacaaagtgctcgttagagatggtactgttgatactcttgttttcacaaacaagacatcactacccactaacgtagcttttgagttgtatgccaagcgtaaggtaggactcaccccacccattacgatcctacgtaacttgggtgttgtttgtacatctaagtgtgtcatttgggactatgaagccgaacgtccacttactacttttacaaaggatgtctgtaaatataccgactttgagggtgacgtttgtacactctttgataacagcattgttggttcattagagcgattctctatgacccagaatgctgtgcttatgtcacttacagctgttaaaaagctcactggcataaagttaacttatggctatcttaatggtgtcccagttaacacacatgaagataaaccttttacgtggtatatttacactaggaagaacggcaagttcgaggactatcctgatggctattttacccaaggtagaacaaccgctgattttagccctcgtagcgacatggaaaaggacttcctaagtatggatatgggtttgtttattaacaagtatggacttgaagattacggctttgagcacgttgtgtatggtgatgtttcaaaaaccacccttggtggtttacatctactaatttcgcaggtgcgtctggcctgtatgggtgtgcttaaaatagacgagtttgtgtctagtaatgatagcacgttaaagtcatgtactgttacatatgctgacaaccctagtagtaagatggtttgcacatatatggatctcctgcttgacgattttgttagcattcttaaatctttggatttgagcgttgtatctaaggttcatgaagttatggttgattgtaaaatgtggaggtggatgttgtggtgtaaggatcataaactccagacattttatccacaacttcaagccagtgaatggaagtgtggttattccatgccttctatttacaagatacaacgtatgtgcttagaaccttgcaatctctataactatggtgctggtgttaagttacctgatggcattatgtttaacgtagttaaatacacacagctttgtcaatatctcaatagcaccacaatgtgtgtaccccatcacatgcgtgtgctacatcttggtgctggctctgataagggcgttgcacctggcacggctgtcttacgacgttggttgccactggatgccattatagttgacaatgatagtgttgattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgttattactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacaccatgcatgccaattatatcttctggcgtaattccacaattatgactatgtcttacaacagtgtgcttgatttaagcaagttcaattgtaagcataaggctacagttgttgttaatttaaaagactcatccattagtgatgttgtgttaggcttgttgaagaatggtaagttgctagtgcgtaataatgacaccatttgtggcttttctaatcatttggtcaacgtaaacaaatgacgcctttaatttacttctggttgttcttaccagtacttctaacacttagcctaccacaagatgtcactaggtgccagtctactattaactttaggcggttcttttcaaaatttaatgttcaggcacctgccgtcgttgttttgggtggttatctacctagtatgaactcttctagctggtactgtggcacaggcattgaaactgatagtggcgttcatggtatttttctcagttacatcgattctggtcagggctttgagattggcatttcgcaagagccgtttgatcctagtggttaccagctttatttacacaaggccactaatggtaacactagtgctattgcacgactgcgcatttgccagtttccagataataaaacattgggccctactgttaatgatgttacaacaggtcgtaactgcctattcaacaaagccattccagctttgcaggatggaaaaaatattgttgtcggcataacatgggataatgatcgtgtcactgtttttgctgacaagatctatcatttttatattaaaaatgattggtcccgtgttgcgacaagatgttacaataaaagaagttgtgccatgcaatatgtttatacacctacctactacatgcttaatgttactagtgcaggtgaggatggcatttactatgaaccttgtacagctaattgcagtggttacgctgccaatgtatttgccactgattccaatggccatataccagaaggttttagttttaataattggtttcttttgtccaatgactccactttgttgcatggtaaagtggtttcaaaccaacctttgttggtcaactgcctttgggccattcctaagatttatggactaggccaatttttctcattcaatcaaacgatggatggcgtttgtaacggagccgctgcgcagcgtgccccagaggctctgaggtttaatattaatgacacttttgtcattcttgctgaaggctcaattgtacttcatactgctttaggaacaaatctttcttttgtttgcagtaattcctcagatcctcacaaagccatctttaccatacctttgggtgttactgaagtaccctactattgctttcttaaagtggatacttacaaatccactgtttataaattcttggctgttttacctcctactgtcaaggaaattgtcatcaccaagtacggtgatgtttatgtcaacgggtttggctatttgcatctcggtttgttggatgctgtcacaattaatttcactggtcatggcactgacgatgacgtttcaggtttctggaccgtagcatcgactaattttgttgatgcactcatcgaggttcaaggaactgccattcagcgtattctttattgtgatgaccctgttagccaacttaagtgttctcaggttgcttttgaccttgatgatggtttttaccctatttcttctagaaaccttctgagtcatgaacagccaatttcttttgttactttgccatcattcaatgatcattcttttgttaatattactgtctctgcggcttttggtggtcatagtggtgccaacctcattgcatctgacactactatcaatgggtttagttctttctgtgttgacactagacaatttaccattacactgttttataacgttacaaacagttatggttatgtgtctaagtcacaggatagtaattgccctttcaccttgcaatctgttaatgattacctgtcttttagcaaattttgtgtttcaaccagccttttggctggtgcttgtaccatagatctttttggttaccctgagttcggtagtggtgttaagtttacgtccctttattttcaattcacaaagggtgagttgattactggcacgcctaaaccacttcaaggtgtcacggacgtttcttttatgactctggatgtgtgtaccaagtatactatctatggctttaaaggtgagggtattattacccttacaaattctagctttttggcaggtgtttattatacatctgattctggacagttgttagcctttaagaatgtcactagtggtgctgtttattctgttacgccatgttctttttcagagcaggctgcatatgttgatgatgatatagtgggtgttatttctagtttgtctaactccacttttaacaataccagggagttgcctggtttcttctaccattctaatgatggctccaattgtacagagcctgtgttggtgtatagtaacataggtgtctgtaaatctggcagtattggctatgtcccacttcaggatggccaagtcaagattgcacccatggttactgggaatattagtattcccaccaactttagtatgagtattagaacagaatatttacagctttacaacacgcctgttagtgttgattgcgttacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccatcagttcgtttaatggtgatggatataactttactaatgtgctgggtgtttccgtgtacgaccctgcaagtggcagggtggtacaaaaagggtcttttattgaagacctgctttttaataaagtggttactaatggccttggtactgttgatgaagactataagcgctgttctaatggtcgctctgtggcagatctagtctgtgcgcagtattactctggtgtcatggtactacctggcgttgttgacgctgagaagcttcacatgtatagtgcgtctctcatcggtggtatggcgctaggaggtcttactagtgcagcggcattgccttttagccatgctgttcaagcgaggctcaattatcttgctttacagacggatgttctacagcgcaaccagcaattgcttgctgagtcttttaactctgctattggtaatataacttcagcctttgagagtgttaaagaggctattagtcaaacttccaatggtttgaacactgtggctcatgcgcttactaaggttcaagaggttgttaattcgcagggttcagctttgacccaacttaccatacagctgcaacacaacttccaagccatttctagttctattgatgacatttactcccgactggacattctttcagccgatgttcaggttgatcgtctcatcaccggcagattatcagcacttaatgcttttgttgctcaaaccctcactaagtatactgaggttcaggctagcaggaagctagcacagcaaaaggttaatgagtgcgtcaaatcgcaatctcagcgttatggtttttgtggtggtgatggcgagcacatcttctctctggtacaggccgcacctcagggcctgctgtttttacatacagtacttgtaccgggtgattttgtaaatgttattgccatcgatggcttatgcgttaatggtgatattgccttgactctacgtgagcctggcttagtcttgtttacgcatgaacttcaaacttatactgcgacggaatattttgtttcatcgcgacgtatgtttgaacctagaaaacctaccgttagtgattttgttcaaattgagagttgtgtggtcacctatgtcaatctgactagcgaccaactaccagatgtaatcccagattacatcgatgttaacaaaacacttgatgagattctagcttctctgcccaatagaattggtcctagtcttcccctagatgtttttaatgccacttatcttaatctcactggtgaaattgcagatttagagcagcgttcagagtctctccgtaatactacagaagagctccgaagtctcatatataatatcaacaacacacttgttgaccttgagtggctcaaccgagttgagacatatatcaagtggccgtggtgggtttggttgattatttttattgttctcatctttgttgtgtcattattagtgttctgctgcatttccacgggttgttgtggatgctgcggttgttgcggtgcttgtttttcaggttgttgtaggggtcctagacttcaaccttacgaagcttttgaaaaggtccacgtgcagtgatgtttcttggactttttcaatacacgattgacacagttgtcaaagatgtctcgaagtctgccaacttgtctttggatgctgtccaagagttggagctcaatgtagttccaattagacaagcttcaaatgtgacgggttttcttttcaccagtgtttttatttacttctttgcactgtttaaagcgtcttctttgaggcgcaattatattatgttggcagcgcgttttgctgtcatttttctttctgttgcacacttattggcaggctttgtttagtctgcttttactcatggcgctataaaaatgcgctctttattatctttaatactacgacactttcttttctcaatggtaaagcagcttattatgacggcaaatccattgtgattctagaaggtggtgaccattacatcacttttggcaactcttttgttgctttcgttagtagcattgacttgtatctagctatacgtgggcggcaagaagctgacctacatctgttgcgaactgttgagcttcttgacggcaagaagctttatgtcttttcacaacatcaaattgttggcattactaatgctgcatttgactcaattcaactagacgagtatgctacaattagtgaatgataatggtctagcagttaatgtcatactttggcttttcgtactctttactttcgtccaattggttaatctgtgcttcacttgtcaccggttgtgtaatagcgcagtttacacacctatagggcgcttgtatagagtttataagtcttacatgcgaattgaccccctccccagtactgttattgacatataaacgaaatatgtctaacggttttattcccgttgatgaggtgattgaacaccttagaaactggaatttcacatggaatatcatactgacgatactacttgtagtgcttcagtatggccattacaagtactctgtgttcttgtatggtgtcaagatggctattctatggatactttggcctcttgtgttggcactgtcactttttgatgcatgggctagcttccaggtcaactgggtctttttcgctttcagcatccttatggcttgcatcactcttatgctgtggataatgtattttgtcaatagcattcggttgtggcgcaggacacattcttggtggtctttcaatcctgaaactgacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattgcctgatttcgtcacagtcgccaaggccactacaacaattgtctatggacgtgttggtcgttcagtcaatgcttcatctggcactggttgggctttctatgtccggtcaaaacacggcgactactcagctgtgagtaatccgagtgcggttctcacagatagtgagaaagtgcttcatttagtctaaacagaaactttatggcttctgtcagctttcaggatcgtggccgcaaacgggtgccattatccctctatgcccctcttagggttactaatgacaaacccctttctaaggtactcgcaaacaacgctgtacccactaataaggggaataaggaccagcaaattggatactggaatgagcaaattcgctggcgcatgcgccgtggtgagcgaattgaacaaccttccaattggcatttctactacctcggaacaggacctcacgccgacctccgttataggactcgtactgagggtgttttctgggttgctaaagaaggcgcaaagactgaacccactaacttgggtgtcagaaaggcgtctgaaaagccaattattccaaaattctctcaacagctccccagtgtagttgagattgttgaacctaacacacctcctgcttcacgtacaaattcgcgtagcaggagtcgtggcaatggcaacaacaggtccagatctccgagtaacaacagaggcaacaaccagtcccgtggtaattcacagaatcgtggaaataaccagggtcgtggagcttctcagaacagaggaggcaataataataacaataacaagtctcgtaaccagtccaagaacaggaaccagtcaaatgaccgtggtggaatgacatcacgcgatgatctggtggctgctgtcaaggatgcccttaaatctttgggtattggagaaaatcctgacaggcataagcaacagcagaagcctaagcaggaaaagtctgacaacagcggaaaaaatacacctaagaagaacaaatccagggccacttcgaaggaacgtgacctcaaagacatcccagagtggaggagaattcccaagggcgaaaatagcgtagcagcttgcttcggacccagggggggcttcaaaaattttggagatgcggaatttgtcgaaaaaggtgttgatgcgtcaggctatgctcagatcgccagtttggcaccaaatgttgcagcattgctctttggtggtaatgtggctgttcgtgagctagcggactcttacgagattacatataactataaaatgactgtgccaaagtctgatccaaatgttgagcttcttgtttcacaggtggatgcatttaaaactgggaatgcaataccccagagaaagaaggaaaagaagaacaagcgtgaaaccacgcagcagcagaatgaagaggccatctacgatgatgtgggtgtgccatctgatgtgacccatgccaatctggaatgggacacagctgttgatggtggtgacacggccgttgaaattatcaacgagatcttcgacacaggaaattaaacaatgtttgaccggcttatcctggctatgttccagggtagtgccattacactgttattactgagtgtttttctagtgacttggctgctgggctatggctttgccctctaactagcggtcttggtcttgcacacaacggtaagccagtggtaatgtcagtgcaagaaggatattaccatagcactgtcacgaggggaacgcagtaccttttcatctaaacctttgcacgagtaatcaaagatccgcttgacgagcctatatggaagagcgtgccaggtatttgactcaaggactgttagtaactgaagacctgacggtgttgatatggataca

SEQ ID NO: 9 - DNA, 28039 bp, porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgcgtggataactagttccgtctagtttgaaaccagtaactgtcggctatggctagcaaccaagtcacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccagaaacatttgtggttggctgttattttctaactgtaattacttcctcgaagagttagagctcacttttggtcgtcgtggtggtaacatcgtgccagttgaccaatacatgtgtggcgctgacgggaaacctgttcttcaggaatccgagtgggagtatacagacttttttgctgactccgaagacggtcaactcaacattgctgggatcacttatgtgaaggcctggattgtagagcgatcggacgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattcttaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagtgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagtttatcgccgaagtgccagagaagttggctgcggctgttacagtttttgtcaacttcttgaatgagctttttgagtctgcctgtgactgcttaaaggtcggaggtaaaacctttaacaaggttggctcctatgtcctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcatacagttgttgttgacggacttgcattcttcgagagtgacgggttttacagacatcttgctgatgctgacgttgtcattgaacatcctgtttataagtctgcttgtgagctcaagccagtttttgagtgtgatccaatacctggttttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcgcttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgaccggcggtgcattgcttgaagccataaatgtatttaaaaagagtaacaaaacagtgcctgctggcaactgtgttacttttgagtgtgcagacatgatttctattactatggtagtattgccatctgatggtgatgctaattatgacaaaaattatgcacgcgccgtcgtcaaggtatctaagcttaaaggcaagttattgcttgctgttggtgatgccacgttgtattccaagttgtcccacctcagcgtggtaggtttcgtatccacacctgatgatgtggagcgtttctacgcaaataagagtgtggttattaaagtcactgaggatacacgtagtgttaaggctgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtccaagtacattgtttctgctggttctgtcactattgaacgtgtcacgcatgacggctgttgttgtagtaagcgtgttgtcactgcaccagttgtgaatgctagcgtattgaagcttggcgtcgaggatggtctttgtccacatggtcttaactacattgacaaagttgttgtagtcaaaggtactacaattgttgtcaatgttggaaaacctgtagtggcaccatcacacctctttcttaagggtgtttcttacacaacattcctagataatggtaacggtgttgtcggccattatactgtttttgatcatgacactggtatggtgcatgatggagatgcttttgtaccgggtgatctcaatgtatctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagctttcttgattttagtactcaggttagcagtgatagcgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtgtcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcaagagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcactttagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatacagattgtcgataaagatggtacttattaccttccttaccctgatccttcaagaatcctctctgcaggtgtgtttgttgatgacgttgttaaaactgatgcacttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgatgttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcctccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgacaaagttggcacttggtggtactgtagctattaaggtgacggagcttagttggaataagaagttgtatgaactcattcagaagtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgttttcttaaagtggatacttacaactccactgtttataaattcttggctgttttacctccaaccgtcagggaaattgtcatcaccaagtatggtgatgtttatgtcaatgggtttggctatttgcatctcggtttgttggacgctgtcacaattaatttcactggtcatggcactgacgatgacgtttcaggtttctggaccatagcatcgactaattttgttgatgcacttatcgaagttcaaggaactgccattcagcgtattctttattgtgatgatcctgttagccaactcaagtgttctcaggttgcttttgaccttgacgatggtttctaccctatttcttctagaaacctcttgagtcatgaacagccaatttcttttgttactttgccatcatttaatgatcattcttttgttaacattactgtctctgcgtcctttggtggtcatagtggtgccaaccttattgcatctgacactactatcaatgggtttagttctttctgtgttgacactagacaatttaccatttcactgttttataacgttacaaacagttatggttatgtgtctaactcacaggacagtaattgccctttcaccttgcaatctgttaatgattacctgtcttttagtaaattttgtgtttccaccagccttttggctagtgcctgtaccatagatctttttggttaccctgattttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctaattccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccatcagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttacacccgactggacattctttcagccgatgttcaggttgaccgtctcatcaccggcagattatcagcacttaatgcttttgttgctcaaaccctcactaagtatactgaggttcaggctagcaggaagctagcacagcaaaaggttaatgagtgcgttaaatcgcaatctcagcgttatggtttttgtggtggtgatggcgatcacattttctctctggtacaggcagcacctcagggcctgctgtttttacatacagtacttgtaccgggtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatctcaatctcactggtgaaattgcaaatttagagcagcgttcagagtctctccgtaatactacagaggagctccaaagtcttatacataatatcaacaacacactagttgaccttgagtggctcaaccgagttgagacatatatcaagtggccgtggtgggtttggttggttatttttattgttctcatctttgttgtgtcattactagtgttctgctgcatttccacgggttgttgtggatgctgcggctgctgctgtgcttgtttttcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatctttaatactacgacactttctttcctcaatggtaaagcagcttactatgacggcaaatccattgtgattctagaaggtggtgactattacatcacttttgggaactcttttgttgctttcgttagtagcattgacttgtatctagctatacgtgggcggcaagaagccgacctacagctgttgcgaactgttgagcttcttgatggcaagaagctttatgtcttttcgcaacatcaaattgtaggcattactaatgctgcatttgactcaattcaactagacgagtatgctacaattagtgaatgataatggtctagtagttaatgttatactttggcttttcgtactctttttcctgcttattataagcattactttcgtccaactggttaatctgtgcttcacttgtcaccggttgtgtaatagcgcagtttacacacctatagggcgtttgtatagagtttataagtcttacatgcaaatagaccccctccccagtactgttattgacgtataaacgaaatatgtctaacggttctattcccgttgatgaggtgattcaacaccttagaaactggaatttcacatggaatatcatactgacgatactactcgtagtgcttcagtatggccattacaagtactctgcgttcttgtatggtgtcaagatggctattctatggatactttggcctcttgtgttagcactgtcactttttgacgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagcctatcattccaaatttctcccaacagcttcccagcgtagttgagattgttgaacctaacacacctcccacttcacgttcaaattcacgtagcaggagtcgtggtaatggcaacaacaggtccagatctccaagtaacaacagaggcaataaccagtcccgcggtaattcacagaatcgtggaaataaccaggatcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaactaaacaatgtttgactggcttatcctggctatgtcccagggtggtgccattacactgttattactgagtgtttttctagtgacttggctgctgggctatggctttgccctctaactagcggtcttggtcttgcacacaacggtaagccagtggtaatgtcagtgcaagaaggatattaccatagcactgtcatgaggggaacgcagtaccttttcaactaaacctttgcacgagtaatcaaagatccgcttgacgagcctatatggaagagcgtgccaggtatttgactcaaggactgttagtaactgaagacctgacggtgttgatatggatacac

SEQ ID NO: 10 - protein, 1386 aa, porcine epidemic diarrhea virus
MKSLTYFWLFLPVLSTLSLPQDVTRCSANTNFRRFFSKFNVQAPAVVVLGGYLPIGENQGVNSTWYCAGQHPTASGVHGIFVSHIRGGHGFEIGISQEPFDPSGYQLYLHKATNGNTNATARLRICQFPSIKTLGPTANNDVTTGRNCLFNKAIPAHMSEHSVVGITWDNDRVTVFSDKIYYFYFKNDWSRVATKCYNSGGCAMQYVYEPTYYMLNVTSAGEDGISYQPCTANCIGYAANVFATEPNGHIPEGFSFNNWFLLSNDSTLVHGKVVSNQPLLVNCLLAIPKIYGLGQFFSFNQTIDGVCNGAAVQRAPEALRFNINDTSVILAEGSIVLHTALGTNFSFVCSNSSNPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSFMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 11 - protein, 1386 aa, porcine epidemic diarrhea virus
MKSLTYFWLFLPVLSTLSLPQDVTRCSANTNFRRFFSKFNVQAPAVVVLGGYLPIGENQGVNSTWYCAGQHPTASGVHGIFVSHIRGGHGFEIGISQEPFDPSGYQLYLHKATNGNTNATARLRICQFPSIKTLGPTANNDVTTGRNCLFNKAIPAHMSEHSVVGITWDNDRVTVFSDKIYYFYFKNDWSRVATKCYNSGGCAMQYVYEPTYYMLNVTSAGEDGISYQPCTANCIGYAANVFATEPNGHIPEGFSFNNWFLLSNDSTLVHGKVVSNQPLLVNCLLAIPKIYGLGQFFSFNQTIDGVCNGAAVQRAPEALRFNINDTSVILAEGSIVLHTALGTNFSFVCSNSSNPHLATFAIPLGATQVPYYCFFKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSFMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 12 - protein, 1386 aa, porcine epidemic diarrhea virus
MKSLTYFWLFLPVLSTLSLPQDVTRCSANTNFRRFFSKFNVQAPAVVVLGGYLPIGENQGVNSTWYCAGQHPTASGVHGIFVSHIRGGHGFEIGISQEPFDPSGYQLYLHKATNGNTNATARLRICQFPSIKTLGPTANNDVTTGRNCLFNKAIPAHMSEHSVVGITWDNDRVTVFSDKIYYFYFKNDWSRVATKCYNSGGCAMQYVYEPTYYMLNVTSAGEDGISYQPCTANCTGYAANVFATEPNGHIPEGFSFNNWFLLSNDSTLVHGKVVSNQPLLVNCLLAIPKIYGLGQFFSFNQTIDGVCNGAAVQRAPEALRFNINDTSVILAEGSIVLHTALGTNFSFVCSNSSNPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSDVKFTSLYFQFTKGELITGTPKPVEGVTDVSFMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASRRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPGYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 13 - protein, 1383 aa, porcine epidemic diarrhea virus
MKSLNYFWLFLPVLSTLSLPQDVTRCQSTINFRRFFSKFNVQAPAVVVLGGYLPSMNSSSWYCGTGLETASGVHGIFLSYIDAGQGFEIGISQEPFDPSGYQLYLHKATNGNHNAIARLRICQFPDNKTLGPTVNDVTTGRNCLFNKAIPAYMQDGKNIVVGITWDNDRVTVFADKIYHFYLKNDWSRVATRCYNKRSCAMQYVYTPTYYMLNVTSAGEDGIYYEPCTANCSGYAANVFATDSNGHIPEGFSFNNWFLLSNDSTLLHGKVVSNQPLLVNCLLAIPKIYGLGQFFSFNQTMDGVCNGAAAQRAPEALRFNINDTSVILAEGSIVLHTALGTNLSFVCSNSSDPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTPKPLEGVTDVSFMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 14 - protein, 1383 aa, porcine epidemic diarrhea virus
  misc_feature (595)..(595): Xaa can be any naturally occurring amino acid
MKSLTYFWLFLPVLSTLSLPQDVTRCQSTINFRRFFSKFNVQAPAVVVLGGYLPSMNSSSWYCGTGLETASGVHGIFLSYIDSGQGFEIGISQEPFDPSGYQLYLHKATNGNHNAIARLRICQFPDNKTLGPTVNDVTTGRNCLFNKAIPAYMQDGKNIVVGITWDNDRVTVFADKIYHFYLKNDWSRVATRCYNKRSCAMQYVYTPTYYMLNVTSAGEDGIYYEPCTANCSGYAANVFATDSNGHIPEGFSFNNWFLLSNDSTLLHGKVVSNQPLLVNCLLAIPKIYGLGQFFSFNQTMDGVCNGAAAQRAPEALRFNINDTSVILAEGSIVLHTALGTNLSFVCSNSSDPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASXCTIDLFGYPEFGSGVKFTSLYFQFTKGELITGTPKPLEGVTDVSFMTLDVCTKYTIYGFKGEGIITLTNSSFLAGVYYTSDSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALQLSARLESVEVNSMLTISEEALQLATISSFNGDGYNFTNVLGVSVYDPASGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPSDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 15 - protein, 1386 aa, porcine epidemic diarrhea virus
  misc_feature (838)..(838): Xaa can be any naturally occurring amino acid
MKSLTYFWLFLPVLSTLSLPQDVTRCSANTNFRRFFSKFNVQAPAVVVLGGYLPIGENQGVNSTWYCAGQHPTASGVHGIFVSHIRGGHGFEIGISQEPFDPSGYQLYLHKATNGNTNATARLRICQFPSIKTLGPTANNDVTIGRNCLFNKAIPAHMSEHSVVGITWDNDRVTVFSDKIYYFYFKNDWSRVATKCYNSGGCAMQYVYEPTYYMLNVTSAGEDGISYQPCTANCIGYAANVFATEPNGHIPEGFSFNNWFLLSNDSTLVHGKVVSNQPLLVNCLLAIPKIYGLGQFFSFNQTIDGVCNGAAVQRAPEALRFNINDTSVILAEGSIVLHTALGTNFSFVCSNSSNPHLATFAIPLGATQVPYYCFLKVDTYNSTVYKFLAVLPPTVREIVITKYGDVYVNGFGYLHLGLLDAVTINFTGHGTDDDVSGFWTIASTNFVDALIEVQGTAIQRILYCDDPVSQLKCSQVAFDLDDGFYPISSRNLLSHEQPISFVTLPSFNDHSFVNITVSASFGGHSGANLIASDTTINGFSSFCVDTRQFTISLFYNVTNSYGYVSKSQDSNCPFTLQSVNDYLSFSKFCVSTSLLASACTIDLFGYPEFGSGVKFTSLYFQFTKGELITGTTKPLEGVTDVSFMTLDVCTKYTIYGFKGEGIITLTNSSFLAGVYYTSVSGQLLAFKNVTSGAVYSVTPCSFSEQAAYVDDDIVGVISSLSSSTFNSTRELPGFFYHSNDGSNCTEPVLVYSNIGVCKSGSIGYVPSQSGQVKIAPTVTGNISIPTNFSMSIRTEYLQLYNTPVSVDCATYVCNGNSRCKQLLTQYTAACKTIESALXLSARLESVEVNSMLTISEEALQLATISSFNGDGYNFTNVLGVSVYDPARGRVVQKRSFIEDLLFNKVVTNGLGTVDEDYKRCSNGRSVADLVCAQYYSGVMVLPGVVDAEKLHMYSASLIGGMVLGGFTSAAALPFSYAVQARLNYLALQTDVLQRNQQLLAESFNSAIGNITSAFESVKEAISQTSKGLNTVAHALTKVQEVVNSQGAALTQLTVQLQHNFQAISSSIDDIYSRLDILSADVQVDRLITGRLSALNAFVAQTLTKYTEVQASRKLAQQKVNECVKSQSQRYGFCGGDGDHIFSLVQAAPQGLLFLHTVLVPGDFVDVIAIAGLCVNDEIALTLREPGLVLFTHELQNHTATEYFVSSRRMFEPRKPTVSDFVQIESCVVTYVNLTRDQLPDVIPDYIDVNKTLDEILASLPNRTGPSLPLDVFNATYLNLTGEIADLEQRSESLRNTTEELQSLIYNINNTLVDLEWLNRVETYIKWPWWVWLIIFIVLIFVVSLLVFCCISTGCCGCCGCCCACFSGCCRGPRLQPYEVFEKVHVQ

SEQ ID NO: 16 - protein, 1380 aa, porcine epidemic diarrhea virus
MRSLIYFWLLLPVLPTLSLPQDVTRCQSTTNFRRFFSKFNVQAPAVVVLGGYLPSMNSSSWYCGTGIETASGVHGIFLSYIDSSQGFEIGISQEPFDPSGYQLYLHKATNESQNGNTNAIARLRICQFPDNKTLGPTVNDVTTGRNCLFNKAIPAYMRDGKDIVVGITWDNDRVTVFADKIYHFYLKNDWSRVATRCYNRRSCAMQYVYTPTYYMLNVTSAGEDGIYYEPCTANCTGYAANVFATDSNGHIPECFSFNNWFLLSNDSTLLHGKVVSNQPLLVNCLLAIPKIYGLGQFFSFNHTMDGVCNGAAVDRAPEALRFNINDTSVILAEGSIVLHTALGTNLSFVCSNSSDPHLAIFAIPLGATEVPYYCFLKVDTYNSTVYKFLAVLPPTVREIVITKYGDVYVNGFGYLHLGLLDAVTINFTGHGTDDDVSGFWTIASTNFVDALIEVQGTSIQRILYCDDPVSQLKCSQVAFDLDDGFYPISSRNLLSHEQPISFVTLPLFNDHSFVNITVSAAFGGLSSANLVASDTTINGFSSFCVDTRQFTITLFYNVTNSYGYVSKSQDSNCPFTLQSVNDYLSFSKFCVSTSLLAGACTIDLFGYPAFGSGVKLTSLYFQFTKGELITGTPKPLEGITDVSFMTLDVCTKYTIYGFKGEGIITLTNSSILAGVYYTSDSGQLLAFKNVTSGAVYSVTPCSFSEQAAYVNDDIVGVISSLSNSTFSNTRELPGFFYHSNDGSNCTEPVLVYSNIGVCKSGSIGYVPPQYGQVKIAPTVTGNISIPTNFSMSIRTEYLQLYNTLVSVDCATYVCNGNSRCKQLLTQYTAACKTIESALQLSARLESVEVNSMLTISEEALQLATISSFNGDGYNFTNVLGASVYDPASGRVVQKRSVIEDLLFNKVVTNGLGTVDEDYKRCSNGRSVADLVCAQYYSGVMVLPGVVDAEKLHMYSASLIGGMALGGITAATALPFSYAVQARLNYLALQTDVLQRNQQLLAESFNSAIGNITSAFESVKEAISQTSKGLNTVAHALTKVQEVVNSQGSALNQLTVQLQHNFQAISSSIDDIYSRLDILSADVQVDRLINGRLSALNAFVAQTLTKYTEVQASRKLAQQKVNECVKSQSQRYGFCGGDGEHIFSLVQAAPQGLLFLHTVLVPGDFVNVLAIAGLCVNGEIALTLREPGLVLFTHELQNYTATEYFVSSRRMFEPRKPTVSDFVQIESCVVTYVNLTSDQLPDVIPDYIDVNKTLDEILASLPNRNGPSLSLDVFNATYPNLTGEIADLEQRSESLRNTTEELRSLINNINNTLVDLEWLNRVETYIKWPWWVWLIIVIVLIFVVSLLVFCCISTGCCGCCGCCGACFSGCCRGPRLQPYEA

SEQ ID NO: 17 - protein, 1382 aa, porcine epidemic diarrhea virus
MTPLIYFWLFLPVLLTLSLPQDVTRCQSTINFRRFFSKFNVQAPAVVVLGGYLPSMNSSSWYCGTGIETDSGVHGIFLSYIDSGQGFEIGISQEPFDPSGYQLYLHKATNGNTSAIARLRICQFPDNKTLGPTVNDVTTGRNCLFNKAIPALQDGKNIVVGITWDNDRVTVFADKIYHFYIKNDWSRVATRCYNKRSCAMQYVYTPTYYMLNVTSAGEDGIYYEPCTANCSGYAANVFATDSNGHIPEGFSFNNWFLLSNDSTLLHGKVVSNQPLLVNCLWAIPKIYGLGQFFSFNQTMDGVCNGAAAQRAPEALRFNINDTFVILAEGSIVLHTALGTNLSFVCSNSSDPHKAIFTIPLGVTEVPYYCFLKVDTYKSTVYKFLAVLPPTVKEIVITKYGDVYVNGFGYLHLGLLDAVTINFTGHGTDDDVSGFWTVASTNFVDALIEVQGTAIQRILYCDDPVSQLKCSQVAFDLDDGFYPISSRNLLSHEQPISFVTLPSFNDHSFVNITVSAAFGGHSGANLIASDTTINGFSSFCVDTRQFTITLFYNVTNSYGYVSKSQDSNCPFTLQSVNDYLSFSKFCVSTSLLAGACTIDLFGYPEFGSGVKFTSLYFQFTKGELITGTPKPLQGVTDVSFMTLDVCTKYTIYGFKGEGIITLTNSSFLAGVYYTSDSGQLLAFKNVTSGAVYSVTPCSFSEQAAYVDDDIVGVISSLSNSTFNNTRELPGFFYHSNDGSNCTEPVLVYSNIGVCKSGSIGYVPLQDGQVKIAPMVTGNISIPTNFSMSIRTEYLQLYNTPVSVDCVTYVCNGNSRCKQLLTQYTAACKTIESALQLSARLESVEVNSMLTISEEALQLATISSFNGDGYNFTNVLGVSVYDPASGRVVQKGSFIEDLLFNKVVTNGLGTVDEDYKRCSNGRSVADLVCAQYYSGVMVLPGVVDAEKLHMYSASLIGGMALGGLTSAAALPFSHAVQARLNYLALQTDVLQRNQQLLAESFNSAIGNITSAFESVKEAISQTSNGLNTVAHALTKVQEVVNSQGSALTQLTIQLQHNFQAISSSIDDIYSRLDILSADVQVDRLITGRLSALNAFVAQTLTKYTEVQASRKLAQQKVNECVKSQSQRYGFCGGDGEHIFSLVQAAPQGLLFLHTVLVPGDFVNVIAIDGLCVNGDIALTLREPGLVLFTHELQTYTATEYFVSSRRMFEPRKPTVSDFVQIESCVVTYVNLTSDQLPDVIPDYIDVNKTLDEILASLPNRIGPSLPLDVFNATYLNLTGEIADLEQRSESLRNTTEELRSLIYNINNTLVDLEWLNRVETYIKWPWWVWLIIFIVLIFVVSLLVFCCISTGCCGCCGCCGACFSGCCRGPRLQPYEAFEKVHVQ

SEQ ID NO: 18 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacctctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcagattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagctgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgtcgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatttacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctattgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactacttttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatctttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaactggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaacaacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagattacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaactcaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgtcatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatctggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaactctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagtttttattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgcactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaatcagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatttatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 19 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtggctcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcctatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctgtcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggattctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacctgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcaacagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaatttcgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttataaccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccttgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcaccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggctttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacatccttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacgcttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagccgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatcttatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatctggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccaaactctcagcatgtatctcctacctagtgagatacaaacttatagctgcggcggtgccatggttaaataccagacacatgatgcagttcgtatcattttagacctcactaccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagatctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaattgctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatacctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagtttttattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaatcagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 20 - DNA, 25406 bp, Porcine Deltacoronavirus
aaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtctaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgcgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggagactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactatttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatttacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgatgatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactacttttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgcctcagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctttacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcctatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactatagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaatccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgccaagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtatactgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttcctcttaactccgccatcaaaaccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggtgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagcaa

SEQ ID NO: 21 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtgtgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcctaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgtgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaaatgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgataatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcaccaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaatcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatatggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacatctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttcctcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 22 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaagttaaggttggagctctaacctatgttaagaccactgattcgccacccctttactttcctaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgtgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttggaattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgctaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctactatgcaatctacctttactttgtccttacgttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaaatgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgataatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaatccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcctactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcaccaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgtttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaatcctgttttgtcctatggacctatcagcgtgtgtagtgatggtgcacttgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatatggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacatctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttcctcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 23 - DNA, 25398 bp, Porcine Deltacoronavirus
tatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacctctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctattattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaatatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaagaaccatttgcaggtgtgggatgctctcaataggaccattgtacgcaccactactgactatgatcaagttaccaccaaggcccttacaccccagggagtgttagaagccaatctcttcgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcatgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgtaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaattacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgtcttgggcactgtatctggtattcacatctttacatcaacagctgcattgcttggatctactattgtgatcatactatgcgttgttgctgttcttgcagttcagcggttcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtatacaccacctaaatttgcagttgttcaaagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaactattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgtkgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttaccactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatttgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggctttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgaccaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcatattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaggagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattttcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaatccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactaccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccattttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaakggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgctatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaatcagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttcctcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggag

SEQ ID NO: 24 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccacacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcatgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcattcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcccttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaatccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcctaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcctactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcaccaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcacttgtgggaacatccacattacagaatactcgaccatccatagtttcactatacgatggcgaagttgaaataccatctgcattttttctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 25 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaagttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggacactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgtgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcctaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactataggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtcaatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtgggggttctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactctactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcaccaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcttatggacctatcagcgtgtgtagtgatggtgcacttgtggaaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaatcagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcattatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaagactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaggctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 26 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggcgcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccatctaaacctggggatgtcatcgtggctactgatgaggaataccttaaatgctttgaaacccctgaggtaggtaggctctataaggttttccaaactcaatcttgggctatcattgagcgttccttctctagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagctgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgtggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgctttcgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcccttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaacgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccattgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcctatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcctaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgtttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagttatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctacacagttggatagcagagagattataaatatgtttcaaatatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttctacttctattcaagacatttacaaccgtcttgaggaagtagaggctaaccagcaagttgaccgtctcatcacaggacgggtggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgttaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggactgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatatatcagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 27 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgccgaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgacatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgctttcgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagagattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctacaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaataacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcccttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaacgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaactcaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatcttatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagttatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaactcggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttagatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgttaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaaccctttaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttcaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 28 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaatcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctattaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgattctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcaacagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcatacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctctttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgcgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccatggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccactctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacatcgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagttatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacactcatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttccctggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctcaggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccactgcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 29 - DNA, 25399 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaagaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggttatgacactaaagctaatgttgtagctacctaccataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaattacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacaatctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcatttcagtattacactgataatgttgttgctcaattatatgcacacttactgactgttgatgctagaccaaaatggctggcacaatctcagataagtatcgaggatttcaactcgtgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctgacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattttaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatgacagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctattaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccactctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcacacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactggccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtctcactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgtacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtattactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatatatcagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttcctcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagcaaaaa

SEQ ID NO: 30 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaagaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggttatgacactaaagctaatgttgtagctacctaccataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaattacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacaatctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcatttcagtattacactgataatgttgttgctcaattatatgcacacttactgactgttgatgctagaccaaaatggctggcacaatctcagataagtatcgaggatttcaactcgtgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctgacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattttaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatgacagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctattaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccactctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcacacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactggccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtctcactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgtacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtattactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatatatcagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttcctcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 31 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaatatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattacctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctgacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgacccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattttaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctattaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaacggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaagcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcacacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactggccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaatcgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttatcttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 32 - DNA, 25396 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatttaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccatctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgccgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggttcaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgcaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttacgttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacaccgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgayacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagaaattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcaccgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaatcgtcttgaggaagtacaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttatcttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaggggggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtattacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagcaa

SEQ ID NO: 33 - DNA, 25404 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatttaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccatctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgccgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggttcaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgcaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttacgttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacaccgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcaccgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaatcgtcttgaggaagtacaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttatcttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaggggggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtattacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattaccctyaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagcaaaaaaaaaa

SEQ ID NO: 34 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatttaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccatctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgccgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggttcaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgcaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttacgttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacaccgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaatgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcaccgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaatcgtcttgaggaagtacaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttatcttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaggggggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtattacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 35 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaatgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgtgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcccttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacattctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcctaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaataccacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgataataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctatagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttatcttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 36 - DNA, 25401 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccatctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgccgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatctgcactggtgattactttctcagtgtactacttttataaggtaatgaagtttttccgccatctcacacatggatgcaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattggctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgtgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcccttttgatgatggttgtaaatgctaacactttttggataccgaacacatttctgcgcacctgctacgaaactatattcggttccycaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgcccttcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcctaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaataccacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggactgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagcaaaaaaa

SEQ ID NO: 37 - DNA, 25393 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgatgctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgacaccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgccgagtctgatgatccacaagatcctgctgtatatgatgatacaacaattataacggacagcactgatgtaggcgatgagcctgatacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcctctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgtggttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttacgttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcctaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaatcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcagcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaattcacctacagcaacacctcctcagtgggatgttggtatctataacaacactattctcaacctcaccgttgagattaacgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggag

SEQ ID NO: 38 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgatgctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgacaccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgccgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcctctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgtggttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttacgttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcctaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaatcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcagcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaattcacctacagcaacacctcctcagtgggatgttggtatctataacaacactattctcaacctcaccgttgagattaacgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 39 - DNA, 25382 bp, Porcine Deltacoronavirus
cattagtctataattttatctccctagcttcgctagttctctaccgacaccaatccaggtgcgtttgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaactttttattcatgttgcagctgctgaagagggtcaccctaaggttactacttaccttggcaactataatctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggttgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctaatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggttggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgtatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaatcagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatttcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttataatttgtaaagaacacaacttctattgcaaggactgctctttacaaacacccggcactttcattccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctactgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgattttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtataaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggactttaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagttttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttataaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagttttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtattgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacactgggactaacctgccattgcaaataggttttagtaccggaaagaatttttcagtcactccagagggaatttgggtaaacgagcatggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgtgtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataatacctacttaggtattcttccacctgatttaactgactttacggtttaccgtactggtcagttctatgctaatggttaccttttaggtactttacctattacggttaactatgttaggttgtatcggggtcatttgtctgccaatagagcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactcaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtttacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgtcactagtggccttggcactgttgatcaggactacaaatcctgctctagagacatggccatcgctgacctagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatatggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgatgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagtttttattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcttaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccacttaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttatag

SEQ ID NO: 40 - DNA, 25320 bp, Porcine Deltacoronavirus
cattagtctataattttatctccctagcttcgctagttctctaccgacaccaatccaggtgcgtttgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaactttttattcatgttgcagctgctgaagagggtcaccctaaggttactacttaccttggcaactataatctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggttgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctaatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggttggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgtatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacgcagaaggagtaattccccaacagtgggaacttcctgatgttgataaatttttactcaagatccaggaacggaagaccagcagcgacgaagtacttagcgtcgacgtctatcctaaatcagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactatactgtttatgcgctttcactaatactactattagctaacatgactcttgtcatgggcacgctaatagttactttctttgtgaacttccatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttataatttgtaaagaacacaacttctattgcaaggactgctctttacaaacacccggcactttcattccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctactgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattatactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgattttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtataaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttataaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtattgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagaccttactgccactgaccacatctctgttgaagtcgttggccaacatggtgaaaattatgtgtttgtttgcagtgagcagtttaactacaccactgcattacacaactctaccttcttctcacttaattctgagctttattgctttactaataatacctacttaggtattcttccacctgatttaactgactttacggtttaccgtactggtcagttctatgctaatggttaccttttaggtactttacctattacggttaactatgttaggttgtatcggggtcatttgtctgccaatagagcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagatacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgtcactagtggccttggcactgttgatcaggactacaaatcctgctctagagacatggccatcgctgacctagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatatggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagtttttattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcttaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccacttaaatatctctttggttccatagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtggga

SEQ ID NO: 41 - DNA, 25382 bp, Porcine Deltacoronavirus
cattagtctataattttatctccctagcttcgctagttctctaccgacaccaatccaggtgcgtttgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaactttttattcatgttgcagctgctgaagagggtcaccctaaggttactacttaccttggcaactataatctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggttgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctaatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggttggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgtatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaatatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcttgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgctattgcaaaattagctggtccaaaatatcaagagtactgtaatagtgtggctcctatctcaggaccgcttaccacggactcttttgatgccaagaaatttggtgtggcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtacttctgcagatgaacctaccggtcctgccattaaatttgccgcagctcactgctggtacactaatggcaagaaaacagttaatggctatgacactaaagctaatgttgtagctacatatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattctatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcattccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaataacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctactgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttactttgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctagcttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgattttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagttttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttataaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtattgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcatggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaattatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataatacctacttaggtattcttccacctgatttaactgactttacggtttaccgtactggtcagttctatgctaatggttaccttttaggtactttacctattacggttaactatgttaggttgtatcggggtcatttgtctgccaatagagcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgtcactagtggccttggcactgttgatcaggactacaaatcctgctctagagacatggccatcgctgacctagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatatggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagtttttattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagttcctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcttaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccacttaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttatag

SEQ ID NO: 42 - DNA, 25394 bp, Porcine Deltacoronavirus
cattagcctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgctgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctattattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaatatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcttgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgctattgcaaaattagctggtccaaaatatcaagagtactgtaatagtgtggctcctatctcaggaccgcttaccacggactcttttgatgccaagaaatttggtgtggcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaactcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacttgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcattccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacctacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgctgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccatatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgattgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatggggctctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgattttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtataaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttataaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtattgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcatggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaattatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataatacctacttaggtattcttccacctgatttaactgactttacggtttaccgtactggtcagttctatgctaatggttaccttttaggtactttacctattacggttaactatgttaggttgtatcggggtcatttgtctgccaatagagcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgtcactagtggccttggcactgttgatcaggactacaaatcctgctctagagacatggccatcgctgacctagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatatggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagtttttattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcttaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccacttaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 43 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgccagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcattccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatattatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaataaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgtaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgttaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatatatcagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 44 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcagctgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatataattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcaaccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcattccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgtgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaataacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaacctgctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcaccaagccttactttaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacatccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggttcatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgttacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 45 - DNA, 25395 bp, Porcine Deltacoronavirus
cattagtctataattttatctccctagcttcgctagttctctaccgacaccaatccaggtgcgtctgccaccaagttgrctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgatgctcgctcggctgaatggacaacttccaagaatgcttttgcactcaaagccactcaacttgactactctgatgccgttttgagggcaatgattcgtttctgccctccaagggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttgttcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaacctacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcattccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttgtgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcaaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacctgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgtatctttgtggatgacgttaacaaggctgaccctgttcagaaccttgaacgttacatctcacttgcaattgatgcatatccccttaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacatgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcatttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaagcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagyagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaasagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccrcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctattggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggaggsttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaactttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagcaa

SEQ ID NO: 46 - DNA, 25396 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagccttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcaccggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgatcctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctttttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgtttctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactacttttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatctcaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttytttgacaatctaataaggatagttaaggagaggctcgccctcggtggttctatctttgttaagataactgaacattcattctcacccgaactctactcacttgckggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagctaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttactgtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcamtaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagtagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcttgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgttacctctccgattcccaaccggagatggcccagctcaaggtttcagagttgaccccttcaacgctagaggaagacctcaggagcgtggaagtggcccaagatctcaatctgttaactccagaggcacaggtaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgacagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttcaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagcaa

SEQ ID NO: 47 - DNA, 25394 bp, Porcine Deltacoronavirus
cattagcctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagccttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcaccggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgatcctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctttttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgtttctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactacttttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatctcaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagctaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttactgtctaccgtactggtcagttctatgctaatggttaccttttaggtactttacctattacggttaactatgttaggttgtatcggggtcatttgtctgccaatagtgcccacttcgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactctcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagtagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcttgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgttacctctccgattcccaaccggagatggcccagctcaaggtttcagagttgaccccttcaacgctagaggaagacctcaggagcgtggaagtggcccaagatctcaatctgttaactccagaggcacaggtaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgacagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttcaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 48 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagccttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtatccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgactaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacttactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtagttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccgctgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctttttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcttttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacggccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcttacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagtttttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaacccaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctttacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccgggtggcactagcagtggtgatgcaaccacagcttatgccaactcggtatttaacatcttacaggtggtttctgctaatgtagccaccttcttatcaacttccaccacgacacatctcaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagtttgcttgcaaagcacaccattctctcaccattccacaatgtgattatgtgtacaatccattcctcatcgacgtggctacgtggggattctcgggacggctttccaccaaccatgacgctgtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcgacagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgctaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcagacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttactgtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgacaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttaaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaaccaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgttacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactctacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgacagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttcaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 49 - DNA, 25394 bp, Porcine Deltacoronavirus
cattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacawaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcratactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgargactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtactacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcgaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattattatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggascaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgcattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggatggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgcgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgtcatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgatgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggatggttgttcgacgtgagattgctactcacattgctgaggtagctcctcacactgattatatatgctttgtcacttgggctcaccagcttgagctagcgacaatgcgctactttgtcaaactaggtatggaagagagatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccatggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaatatcaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttactgtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgwcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttagatagcagagagattataaatatgtttcgaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagctactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaaccaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaagtctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgttacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 50 - DNA, 25394 bp, Porcine Deltacoronavirus
cattagtctataattttatctccctagcttcgctagttctctaccgacaccaatccaggtgcgtctgccactaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgttggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaacttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcgaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggatggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgcgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgtcatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctatcgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgatgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggatggttgttcgacgtgagattgctactcacattgctgaggtagctcctcacactgattatatatgctttgtcacttgggctcaccagcttgagctagcgacaatgcgctactttgtcaaactaggtatggaagagagatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaatatcaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagttaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgatatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttactgtctaccgtactggtcagttctatgctaatggttaccttttaggtactttacctattacggttaactatgttaggttgtatcggggtcatttgcctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgacacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttagatagcagagagattataaatatgtttaaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagctactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaaccaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacacgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaagtctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgttacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactctacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 51 - DNA, 25422 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaactttttattcatgttgcagctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcgccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctggaggctgttgatgtcgttgttggtaatactgtactgcaaatggctactgatggcactgcgttctacccatcggatggtacgcacgcctctcttccaggattcaaagcaggttcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccaactaaggttgagttagttgttggtgaattggcgagtattaaatttgacaattctgttctagtcaaccctgctaatgcgcaattaacaaatggcggtggagctgctcgtgcaattgcaaaattagctggtccaaaatatcaagagtactgtaatagtgtggctcctatctcaggaccgcttaccacggactcttttgatgccaagaaatttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaatccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatcttaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtatttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgatggtcaagactccctacatttgtatccgcatttacgtgttaatcagcagccccttcagaccactgactacactgtttatgcgctttcactaatactactattagctaacatgactcttgtcatgtgcacgctaatagttactttctttgtgaacttctatggtgtgcaaataccattttatggtacacttttgatagattatcaatccgcactggtgattactttctcagtgtactacttttataaggtaatgaagtttttccgccatctcacacatggatgtaaaattccaacgtgtgtggtatgtgccaaacttcgtaccccacctactataacagttgagactgtcgttcagggcaggaaatacccatctgttattgaaacaaatggcgggtttacaatttgtaaagaacacaatttctattgcaaggactgctctttacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacctattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccttctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaactcatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaatgcaaagtgcaccttcttacagtatcaggacactagacaactctattgctatgatactgttcctactgaacataagctctactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgtcaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtaggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtatccaatagtactgccatgcttcactgtcgtggcattcctgttgactttaaccattaaacacactgttgtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaataagggagaggttgaattgtactttgttactaagcagtgtgcagctaaagtcttcgaaatcgaggaggaatgctacaacgctcttagtacagagctttatactactgatgatacatttggtgtccttgccaaaactgagttctttaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggggatattcttaaccgttgtgttcttaatgccaataagtttgctagtgcctgtatagacgctggtcttgttggcatattaacacccgacaaccaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaactcggtatagtccttaaccaggacgttaccacacacatggcaaatattaatctaaacactctattgcgattggttggtgatcccaccactattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatctgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcccagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaacttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtgtgcacatatcatgctaatgcccatgttgcatcagctgatgcaatcatgacggtatgtttagctatccatgaactgttcagtactgttgactggaactttgaatttccagtaactgctgagcaatcgcaacttaacaaggcctgtcgcttagtacaggcgaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtttacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcgtcgccgttgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaacatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttttatgctgttttaattatttggggcttgctaaggaaaacattaatggttttaacttacatgcttcctatattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcagggcgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataataattttgatgttggcgttcttcctggctaccccactaagaacgttaacctcttctcaccacttactaactccactttgcccattaatggccttcatcggagttaccaaccactcatgctgaattgtcttactaaaataactaaccacactctcagcatgtatctcctacctagtgcgatacaaacttatagctgcggcggtgccatggttaaataccagacacatgatgcagttcgtatcattttagacctcactgccactgaccacatctctgttgaagtcgttggccaacatggtgaaaattatgtgtttgtttgcagtgagcagtttaactacaccactgcattacacaactctaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccactttcaactgcactaagcctgttttgtcctatggacctatcagcgtgtgtagtgatggtgcaattgtgggaacatccacattacagaatactcgaccatccatagtttcactatacgatggcgaagttgaaataccatctgcattttctctttccgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatcacagtcgtccagatacggtttctgtggaaatggcacacacatcttctcacttacacagactgcaccaaatggcatatttttcatgcatgcagtgctagtacccaacaaattcacacgtgtcaacgcttctgccggcatttgtgtggataatacgagaggctactcattgcagcctcaacttatactctaccagtttaataactcctggagagttacacctagaaatatgtatgaacccagactgccccggcaggctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaacttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaatacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccagggaggctatgccacgcgtaatcgtgtgatctatgttattaaacttattctgctttggctgctccaacccttcaccctagtggtgaccatttggaccgcagtcgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaatttgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactcccattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcctactcaatcacagtcaaggagggttctcctgactatgagagacttaaggatgcgctcaatacggtcgttaaccagacctatgagccacctaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcatagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtgggtgtagcagtcgcccagtgggaaagcgccaactaggttacaattgtggtggggacaaattaggggaaattaaattggcttataggggggatggagc

SEQ ID NO: 52 - DNA, 25438 bp, Porcine Deltacoronavirus
acatggggactaaagataaaaattatagcattagtctataattttatctccctagcttcgctagttctctaccgacaccaatccaggtgcgtttgccatcaagttggctaccctttctaggggcgcttctgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgactaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcacgttgcagctgctgaagagggtcaccctaaggttactacttaccttggcaactataacctctatgccaccaaggctccgcctggcgtgcaggttcttagtgctaaaacctctcttactgactttgagaatgtctttggagcccaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtgactgatggtaaggctgaagcaattgcaactaagcctctgcctgctgccactaaaggcaagccaatcacagaggatgtcaaccttctcccagactatcagcagctgcttgttgatcaagtgactggcactgaggttaaggttggagctctaacctatgttaagaccactgattcaccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgactgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtatgaagatccgcgtgtccaaagctttatcagcatttataagttttctgcaaacccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcaccggcacctttcttctcacgaaggcaactactaagatactcaataaggcaaagtacatctttgatgtggagcctgagtacccagtagatgtaacaacatccaaagttgtagtacatgaagcactccagcaaatcgacactaagcctactagagctctagaggctgttgatgtcgttgttggtaatactgtactgcaaatggctactgatggcactgcgttctacccatcggatggtacgcacgcctctcttccaggattcaaagcaggctcggatgagcttttcataagcttcaactgcgacctctttgatgatgagactaatgctcaaatcaacgaaacactcgctgcatatgagcttaaccaattagtggctccaggtgattctacaccgcgtcaaattgcgacattggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggacccagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggagagtttgattctgatgatgaaattattattcctatagtaccagtaacacctgcggatttaaaaccacagactgttactataaaggagtactttaagtctgaaaaacttgagactattaacgaaggatccacagagtcagttacacaatctgacgattcattcgacgagtcatttgttgatgctgagtctgatgatccacaagatcctgctgtatatgatgatacaacaattataacggacagcactgatgtaggcgatgagcctgagacaactctagctaccatcgttaacacacctctgacactcgataataacttgccacctgaagccattaaacaacccagcccgactaaggttgagttagttgttggtgaattggcaagtattaaatttgacaattctgtcctagtcaaccctgctaatgcgcaattaacaaatggcggtggagctgcccgtgcaattgcaaaattagctggtccgaaataccaagagtactgtaatagtgtggctcctatctcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaatagaaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatctcaatggtaatccaaacagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaaatgtgatgtgtggactccctttacacctcagagtggaaaaggtgcagttgcaattggtacttctgcagatgaacctacaggtcctgccattaaatttgccgcagctcactgctggtacactaatggcaagaaaacagttaatggctatgacactaaagctaatgttgtagctacttatcataggtttgacgtgcctaagcctcaacttgtcgaggacgtggttgcgctgcctactaaaaatgactttgaagttctcaatgttgaagaactgccacaggatagtgtgctccatttggacccacctcctgtacaggccttacaacctaaggctaaccaacacattgagattttagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggtactcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttctgatagattatcagtccgcgctgatgatgactttctcagtgtactacttttataaggtaatgaagtttttccgccatctcacacatggatgtaaaattccaacgtgtatggtatgtgctaaacttcgtaccccacctactataacagttgagactgtcgttcaaggcaggaaatacccatctgttattgaaacaaatggcgggtttacaatttgtaaagaacacaacttctattgcaaagactgctctctacaaacacccagcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagattacacccacaggtgacatctttacagacattaagcaagcgaccaatggccaagctagtgactctgctattaatgcagctgttctggctgtccagcgcggtcttgattttacaattgacaaccctaacaatatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgtaacatgcgctgttactccatctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagttttggatactgttcgctcaaatgacaagtgctttgcaaataagtttttggcatttgatagcttcattcaagcaccttacactaattcacctgactgtccagtcgttgtgggagttgttgaagtaacgacgcactctattcctggaattccagcaggtgtcattcatagagacggtctcatacttaacatttatgaacagtctctttatgaaacccatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaacgcaaagtgcaccttcttacagtatcaggacactagacaactctattgctatgatactgttcctactgaatataagctttactctgatgtgcttccgcacgtcgagtataaggctattgacattaatggtgatcttgttcctttcaagataccggagcagataatgttctatccacatattgtgcgctatactagcaattcctattgccgtatggggcattgttttaatactaaccctggtatttgcatttcatttacggacgaatttccgtatagtgaaaatgttaaacccgatgtatactgtgctgatacctctttgcagttgttttcaaacctcgttttgggcactgtatctggtattcacatttttacatcaacagctgcattgcttggatctactattgtgatcatactatgcgttgttgctgttcttgcagttcagcgattcttcaaggagtacacaacttttgttatgtacacttgtggtcttgctcttgtcaacattgtgggcattgcacttatgtacaagtgccttgtcttcgcgatcttctattatgcaatctacctttactttgtccttaccttcccctcctttaagaggaatgtggcattgttttacttcgctgtagtgatcgtgccgcacgtgagtaacatgcaattgcttgtgctcattgtgtgtagcattatctactttctctacacctatgttcatactgtagctaagacagctgggaaattctcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggccttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgacggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaacagctcgagtccctgtagaacgtatcctcaataccattatacagctaaccaccaatagagatggtgcttgtattatgggatcttatgatttcgagtgtgattggacgccagagatggtatacaatcaggctccaatttcattgcagtcaggagtagttaagaaaacttgtacgtggttcttccacttcttgtttatggctattaccatgctactcgctgccatgcatgttttccctgtacacctgtacccaatagtactgccatgcttcactgtcgtggcattcctgttgactttaaccattaaacacactgttgtgtttaccactacatatttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcgattcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagtcggaatttctaatgacaaccttaaagttatttttaacgataaggacagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaataatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggacccccctatgcgcttcgcacataccgtaggtggaaaacagtctgttgtctatctctattttattcagaatattagttcactcaacagaggtatggttattggccacatctccgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggttaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaagaatgctacaacgctcttagtacagagctttatactactgatgatacatttggtatccttgccaaaactgagttcttcaagtttgacaagatacctaatgtcaatcgccagtatctgactaaatatacactcctggacttggcttatgctctacgtcatttgtcaacatctaaggacgttattcaagaaattttgatcaccatgtgcggaacccctgaagattggtttggggaaaattggtttgatccaattgagaacccatccttttacaaggagttccataaacttggagatattcttaaccgttgtgttcttaatgccaataagtttgctagtgcctgcatagacgctggtcttgttggcatattaacacccgataatcaagacctcctgggtcagatctatgactttggagattttattattacacaaccaggtaatggatgtgtggacctagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggatcgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccatcttgtggtccagacagtgggtgtacacttgaaagaacttggtatagtccttaaccaggacgttaccacacacatggcaaatattaatctaaacactctattgcgattggtaggtgatcccaccaccattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtaccttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacacttactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatcagaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacaacatactgtgttagcagagcatgatggtaaaccttactacttaccttacccagatgtctctcgcattctgggtgcatgcatctttgtggatgacgttaataaggctgaccctgttcagaaccttgaacgttacatctcacttgcaattgatgcatatcctctcaccaaggttgaccctattaagggtaaagtcttctatttgttactagactacatacgtgttcttgctcaggagttacaggacggtatccttgatgccttccaatcactcactgacatgtcgtatgtaaataactttatgaatgaggccttttacgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctattaacaactacatttgtagtgttgagaattgcaatgaggacaatgttgaaaaacttttcatttccggcactgcgatttattgtgagaatcacaaacccacgctgtgcatacccattgtagctaatggttctgtttttggtatctaccgccacactgcccgtggtagtgatgacatagacctctttaacgagcttgctacatctaactatgacactattgaaccttatcagaaggccaatcgtgcacctttatcacttatgctcttcgctgctgaaactattaaggcactcgaggagtctattaagaagtcatatgctaccgcaactgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcctaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaaacacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgttgagaaaaatctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgtcgaagcagcacacgccataaaacctaacaccgggactaacctgccattgcaaataggttttagtaccggaaagaatttttcagttactccagagggaatttgggtaaacgagcacggatcttgcactgagctcgtccctgccaaaatacctcctggagaacaatttcgtcaccttaagaaggacatgcgccaggcgcgcccttggaaggttgttcgacgtgagattgctactcacattgctgaggtagctcctcacactgattatatatgcttcgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtataatccattcctcatcgacgtggctacgtgggggttctcgggacggctttccaccaaccatgacgcggtatgcacatatcatgctaatgcccatgttgcatcagctgatgcaatcatgacggtatgtttagctatccatgaactgttcagtactgttgactggaaccttgaatttccagtaactgctgagcaatcacaacttaacaaggcttgtcgcttagtacaggcaaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcactgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgccacacataaactcaacttggctccactcatctactactctaccacagattgtagtagtgaacagcctattgttgttacttacagagattgtgtcacccggtgcaatactggaaaaactctctgtccaaaccatgctcttgaataccaagagtttatcaatgcatacaatctcatggctcgccatggatttaatgtttacataccacgcaatgtcaacgtctataattgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaactctttgacaatcgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatatatgtacgctataacaatcaactgaccacattttctactacttgtacacagggtagaaatgttgagcagtttatacctaaaacacctatggaaagagacttccttgagatgtctcaacagtccttcatccagcaatatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccgtctgtgtacaaaacattggttactgacttacaaccagctgacatccctaattatcactcctacacccctcgggtgcctggagtagttaagaatgttatcaagtaccgacaacttttcaactacatagttaaaaaggataggttggcagtaccacacaatatgaccgtattacaccttggggctgcatctgcactaggtacagcaccaggttcttcagtcataaaacaaatgtttcctgaaggaactgttcttattgaccttgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacctgaactctactcacttgcgggttggttcgatgattatcaactattttgcacagcagttaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcagacaacccgtctacggcctgtaagctaaaagcaacgcctattatctcggctcgtgagttagagaagaagcctattcttcgctatctcgttgcatcaggacgccttcttgtgaggccaccagaatgcagagagctctattgattatgaccttactttgtctcgttcgagcaaagtttgctgatgatctactcgatttgctcaccttcccgggtgcacatcgcttcttacataaactcacgagtaattccagcagtctctactcgcgggctaataactttgatgttggcgttcttcctggctaccccactaagaacgttaacctcttctcaccacttactaactctactttgccaattaatggccttcatcggagttaccaaccactcatgctgaattgttttactaaaataactaaccaaactctcagcatgtatctcctacctagtgagatacaaacttatagctgcggcggtgccatggttaaataccagacacatgatgcagttcgtatcattttagacctcactgtcactgaccacatctctgttgaagtcgttggccaacgtggtgaaaattatgtgtttgtttgtagtgagcagtttaactataccactgcattacacaactctacctttttctcacttaattctgagctttattgctttactaataacacctacttaggtattcttccacctgatttaactgactttacggtctatcgtactgggcagttttatgctaatggttaccttttaggtactttacctattacggttaactatgtaaggttgtatcggggtcatttgtcggccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactctgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcattaaacaatggcatgtcattctctcaattttgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaataacaccgttgtcggtgctatcacatccagtaactcaactgaaaataataggtttactactactattgtcacacctactttcttttattccacaaatgccaccaccttcaactgcaccaagcctgttttgtcctatggacccatcagcgtgtgtagtgatggtgcaattgcgggaacatccacattacagaatactcgaccatccatagtttcactatacgatggcgaagttgaaataccatctgcattttctctttctgttcagacggagtatttgcaagttcaagcagagcaagttatagttgattgtcctcagtatgtatgcaatggcaacagccgttgtctacaattactagcacaatacacctcagcttgctctaacattgaagtagctctgcattcctctgcacagttggatagcagagagattataaatatgtttcaaacatcaacacagtccttgcagttagctaatattaccaacttcaagggtgactacaattttagcagcatactaaccaccagactaggtggcagatctgctattgaagaccttctttttaataaagttgttactagtggccttggcactgttgatcaggactacaaagcctgctctagagacatggccatcgctgacttagtttgttcccagtattacaatggcatcatggttctacctggtgttgttgatgctgagaaaatggcaatgtatactggctctcttactggagctatggtatttgggggactgactgctgcagcggcaataccatttgccacggcagtacaagcccgtctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggtgaggcattatcacacctgactgcacagctgtcaaacaattttcaagcaatttcgacttctattcaagacatttacaaccgtcttgaggaagtagaggctaaccagcaagttgaccgtctcattacaggacggttggctgcacttaatgcatatgttactcagttactcaatcagatgtctcagattagacaatctcgattgttagctcagcaaaagattaatgagtgtgtcaaatctcagtcgtccagatacggtttctgtggaaatggcacacacatcttctcacttacacagactgcaccaaatggcatatttttcatgcatgcagtgcttgtacccaacaaattcacacgtgtcaacgcttctgccggcatttgtgtggataataccagaggctactcattgcagcctcaacttatactctaccagtttaataactcctggagagttacacctagaaatatgtatgaacccagactgccccggcaagctgatttcatacaattaactgattgcagcgttactttttacaacaccaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtagaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaaaaagaaaaggtataccgacgaccaaccaacaccgtcctttaagtttaaggaatggtagtcgacgactgggccgttaccatccctggacaatatattattgctatactagttgtcatctgcattggtgtggcactactttttattaacacttgcttagcttgtgttaaattattttacaagtgctacctaggggcagcataccttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaaggaggctatgccacgcgtaatcgtgtgatctatgttattaaacttattctgctttggctgctccaacccttcaccctagtggtgaccatttggaccgcagttgacagatcatctaagaaggacgcagttttcattgtgtccataatttttgccgtactgaccttcatatcctgggccaagtactggtatgactcaattcgcttattaatgaaaaccagatctgcatgggcactctcacctgaaagtagactccttgcagggattatggatccaatgggtacatggaggtgcattcccatcgaccacatggctccaattctcacaccagtcgttaagcatggcaagctcaagctacatgggcaagagctggccaatggcatatcagttagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacactataaccacttcaaaggccggtgacgctcgcctgtataagtatatgtaatgtgcaactgccatttgcagctgcgagatttatatagattgtgcaataagctgcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggccgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggcactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggtaatcagcccaggaaacgcgaccaatctgcaccagctgcggtacgtcgtaagacccagcatcaagctcccaagcggactttacccaagggtaaaaccatttctcaggtatttggcaaccggtctcgcactggtgccaatgtcggctctgcagacactgagaagacgggtatggctgatcctcgcatcatggctctagccagacatgtgcctggtgttcaggaaatgcttttcgctggccaccttgagagcaactttcaggcaggggcaattacccttaccttctcttactcaatcacagtcaaggagggttctcctgactatgagagacttaaggatgcgctcaatacggtcgttaaccagacctatgagccacccactaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcactctatgtctgttaaacccacccaattccactcaaatatctctttggtttcagagagtcatagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagcaaaaaaaaaaaaaaaaaaa

SEQ ID NO: 53 - DNA, 25419 bp, Porcine Deltacoronavirus
acatggggactaaagataaaaattatagcattagtctataattttatctccctagcttcgctagttctctaccgacaccaatccaggtgcgtctgccaccaagttggctaccctttctaggggcgcttctgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgactaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaactcttcattcacgttgcagctgctgaagagggtcaccctaaggttactacttaccttggcaactataacctctatgccaccaaggctccgcctggcgtgcaggttcttagtgctaaaacctctcttactgactttgagaatgtttttggagcccaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattcaggacaaggaacttgctgagttagcttgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtgaccgatggtaaggctgaagcaattgcaactaagcctctgcctgctgccactaaaggcaagccaatcacagaggatgtcaaccttctccctgactatcagcagctgcttgttgatcaagtgactggcactgaggttaaggttggagctctaacctatgttaagaccactgattcaccacccctttactttcccaaagtcaagggtggtgttattggtattgcacttaagcagcagggcactgcggctaagaagctcaatgtagtcttccatgctcaacctgatgacgttctgctagccttcatacaacttcagcaattcttgaaccgtacttcggattcaagtgttgaaattactgattgccagagttatgaagtatctccaactgtgacggtcaaaattggtccgtctaaacctggggatgtcatcgtggctactgatgaggaataccttaaatgctttgaaacccctgaggaaggtaggctctataaggttttccaaactcaatcttgggctatcattgagcgtgccttctccagtatgaagatccgcgtgtccaaagctttatcagcatttataagttttctgcaaaaccttgcagataactttactgcaataagtggtgttgtcactgcactcattcatgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaatcgacactaagcctactagagctctagaggctgttgatgtcgttgttggtaatactgtactgcaaatggctactgatggcactgcgttctacccatcggatggtacgcacgcctctcttccaggattcaaagcaggctcggatgagcttttcataagcttcaactgcgacctctttgatgatgagactaatgctcaaatcaacgaaacactcgctgcatatgagcttaaccaactagtggctccaggtgattctacaccgcgtcaaattgcgacattggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgttgacgtctatcctaaaccagagccggtcggcaatgttgggattgacgacagcgcgtcggaaaagaagccaaatggggacccagtaccggatcctgaggtccatccaacactagagagtgtggatgttgaacgaccaaccgaaacagcaaaccaggctgttgaagacacaccttctgataccacctttgtggttgatgaagtacaattacaagaatcaacaccagaacctgaactccgctcctatgagggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagaccctgctgtatatgatgatacaacaattataacggacagcactgatgtaggcgatgagcctgagacaactctagctaccatcgttaacacacctctgacactcgataataacttgccacctgaagccattaaacaacccagcccgactaaggttgagttagttgttggtgaattggcgagtattaaatttgacaattctgtcctagtcaaccctgctaatgcgcaattaacaaatggcggtggagctgcccgtgcaattgcaaaattagctggtccaaaatatcaagagtactgtaatagtgtggctcctatctcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacattatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttattcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatctcaatggtaatccaaacagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtacttctgcagatgaacctacaggtcctgccattaaatttgccgcagctcactgctggtacactaatggcaagaaaacagttaatggctatgacactaaagctaatgttgtagctacttatcataggtttgacgtgcctaagcctcaacttgtcgaggacgtggttgcgctgcctactaaaaatgactttgaagttctcaatgttgaagaactgccacaggatagtgtgctccatttggacccacctcctgtacaggccttacaacctaaggctaaccaacacattgagattttagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggtattcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgacgcttgtcatgggcacgctaatagttactttctttgtgaacttctatggtgtgcaaataccattttatggtacacttctgatagattatcagtccgcgctgatgatgactttctcagtgtactacttttataaggtaatgaagtttttccgccatctcacacatggatgtaaaattccaacgtgtatggtatgtgctaaacttcgtaccccacctactataacagttgagactgtcgttcaaggcaggaaatacccatctgttattgaaacaaatggcgggtttacaatttgtaaagaacacaacttctattgcaaagactgctctctacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaatatattaccacattacgcctttgacttttcaaccctcaatgcagaagaccagtctaccattttggagagtggttgtgctaaaggcaatctcacgggcactaatgttggtgttgttctttcagctagccttgttacacgtcttagtcagcaggctatacgtgtgattgctaatgctgcttcacgtaatggtgtaacatgcgctgttactccatctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgctcaaatgacaagtgctttgcaaataagtttttggcatttgatagcttcattcaagcaccttacactaactcacctgactgtccagtcgttgtgggagttgttgaagtaacgacgcactctattcctggaattccagcaggtgtcattcatagagacggtctcatacttaacatttatgaacagtctctttatgaaacccatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaacgcaaagtgcaccttcttacagtatcaggacactagacaactctattgctatgatactgttcctactgaacataagctttactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgttaaacccggtgtatactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttgtgtacacttgtggtcttgctcttgtcaacattgtgggcattgcacttatgtacaagtgccttgtcttcgcgattttctattatgcaatctacctttactttgtccttactttcccctcctttaagaggaatgtggcattgttttactttgctgtagtgatcgtgccgcacgtgagcaacatgcagttgcttgcgctcattgtgtgtagcattatctactttctctacacttatgttcatactgtagctaagacagccgggaaattttcttccttcttagacgcagctaaagctacttttgtcattgacaatgataagtacgtgttgcttaaagaccttgctggtgctgaatttgaccagtatctggcttcttacaacaagtacaaatacttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccctcaggtgtagttgagcgatgcatggtttcagttgtctacaatgggtctgcattgaatggcatctggcttaagaatgtcgtctactgcccacgccatgtaattggaaaattccgtggtgaccagtggactcacatggtctcaattgctgattgccgcgactttatagtcaagtgtccaacacagggtattcagctaaatgtccaatcagttaagatggtaggagctctcctccagttaactgttcataccaacaacacagccactccagactataagtttgaaaggcttcaaccagggtcatcgatgacaattgcttgtgcctatgatggcattgtacggcatgtctatcacgtggtcctccaacttaataatcttatttatgcaagcttccttaatggggcttgtggtagtgtgggttacactcttaagggtaaaacactctacttacattacatgcaccacattgagtttaataacaaaactcatagtggtacagatcttgaaggtaacttctatggcccctatgtggatgaggaagttattcagcagcaaacagcattccagtattatactgataatgttgttgctcaattatatgcacacttactgactgttgatgctagaccaaaatggctggcacaatctcagataagtatcgaggatttcaactcgtgggctgctaacaattcctttgctaacttcccatgtgaacaaactaatatgtcctacattatgggactctcgcaaactgctcgagttccggtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtacccaatagtactgccatgcttcactgtcgtggcattcctgttgactttaaccattaaacacactgttgtgtttaccactacatatttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcgattcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggtgtcacaaacaagcacgctgtttgcaaaaagattgtgaaactccacaatgatacccttaaagccaccacttatgaggaggtagaggtagcacttgtgaaacttctttctcacataattgagttcttgccaactgatcaggtagatgcttatctagctgatacggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagagggcaacacacttatacataagggagttcgctacactattgtgaagaaactctccttagataatgcacctattgaaggcgtaccagaagaattccctgtggtcgtcgagactgttagggaaggtgtgccccagttgcaaaacaatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggaccctcctatgcgctttgcacatactgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggtcaattatgactgcacctgtggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaggaatgctacaacgctcttagtacagagctttatactactgatgatacatttggtatccttgccaaaactgagttcttcaagtttgacaagatacctaatgtcaatcgccagtatctgactaaatatacactcctggacttggcttatgctctacgtcatttgtcaacatctaaggacgttattcaagaaattttgatcaccatgtgcggaacccctgaagattggtttggggaaaattggtttgatccaattgagaacccatccttttacaaggagttccataaacttggagatattcttaaccgttgtgttcttaatgccaataagtttgctagtgcctgtatagacgctggtcttgttggcatattaacacccgataatcaagacctcctgggtcagatctatgactttggagattttattattacacaaccaggtaatggatgtgtggacctagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaacttggtatagtccttaaccaggacgttaccacacacatggcaaatattaatctaaacactctattgcgattggtaggtgatcccaccaccattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtaccttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatcagaagtggtagtctctggtaacaacctctatgtaaaaccaggtggcactagcagtggtgatgcaaccacagcttatgccaactcggtatttaacatcttacaggtggtttctgctaatgtagccacctttttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaataaggctgaccctgttcagaaccttgaacgttacatctcacttgcaattgatgcatatcctctcaccaaggttgaccctattaagggtaaagtcttctatttgttactagactacatacgtgttcttgctcaggagttacaggacggtatccttgatgccttccaatcactcactgacatgtcgtatgtaaataactttatgaatgaggccttttacgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctattaacaactacatttgtagtgttgagaattgcaatgaggacaatgttgaaaaacttttcatttccggcactgcgatttattgtgagaatcacaaacccacgctgtgcatacccattgtagctaatggttctgtttttggtatctaccgccacactgcccgtggtagtgatgacatagacctctttaacgagcttgctacatctaactatgacactattgaaccttatcagaaggccaatcgtgcacctttatcacttatgctcttcgctgctgaaactattaaggcactcgaggagtctatcaagaagtcatatgctaccgcaactgtcaaggatgtgtatgaccaacgcttcattaaacttctatgggaacagggtaaaaagccaccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaatctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgtcgaagcagcacacgccataaaacctaacaccgggactaacctgccattgcaaataggttttagtaccggaaagaatttttcagttactccagagggaatttgggtaaacgagcacggatcttgcactgagcccgtccctgccaaaatacctcctggagaacaatttcgtcaccttaagaaggacatgcgccaggcgcgcccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaacccattcctcatcgacgtggctacgtggggattctcgggacggctttccaccaaccatgacgcggtatgcacatatcatgctaatgcccatgttgcatcagctgatgcaatcatgacggtatgtttagctatccatgaactgttcagtactgttgactggaaccttgaatttccagtaactgctgagcaatcacaacttaacaaggcctgtcgcttagtacaggcaaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtctataactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaactctttgacaatcgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttatttgtacagcactgaccctaaatggcctcgccattgacggtgaagagctatacatatatgtacgctataacaatcaactgaccacattttctactacttgtacacagggtagaaatgttgagcagtttatacctaaaacacctatggaaagagacttccttgagatgtctcaacagtccttcatccagcaatatcaattgcaggaactgggtgttgaacccattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccgtctgtgtacaaaacattggttactgacttacaaccagctgacatccctaattatcattcctacacccctcgggtgcctggagtagttaagaatgttatcaagtaccgacaacttttcaactacatagttaaaaaggataggttggcagtaccacacaatatgaccgtattacaccttggggctgcatctgcactaggtacagcaccaggttcttcagtcataaaacaaatgtttcctgaaggaactgttcttattgaccttgatataagagagttcacttcagatgctaaccaaataatagttacagactacagaacttatataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagttaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcaggacgccttcttgtgaggccaccagaatgcagagagctctattgattatgaccttactttgtctcgttcgagcaaagtttgctgatgatctactcgatttgctcaccttcccgggtgcacatcgcttcttacataaactcacgagtaattccagcagtctctactcgcgggctaataactttgatgttggcgttcttcctggctaccccactaagaacgttaacctcttctcaccacttactaactctactttgccaattaatggccttcatcggagttaccaaccactcatgctgaattgtcttactaaaataactaaccaaactctcagcatgtatctcctacctagtgagatacaaacttatagctgcggcggtgccatggttaaataccagacacatgatgcagttcgtatcattttagacctcactgtcactgaccacatctctgttgaagtcgttggccaacatggtgaaaattatgtgtttgtttgtagtgagcagtttaactataccactgcattacacaactctaccttcttctcacttaattctgagctttattgctttactaataacacctacttaggtattcttccacctgatttaactgactttacggtctatcgtactgggcagttttatgctaatggttaccttttaggtactttacctattacggtcaactatgtaaggttgtatcggggtcatttgtcggccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaaatacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaactcaactgaaaataataggtttactactactattgtcacacctactttcttttattccacaaatgccaccactttcaactgcaccaagcctgttttgtcctatggacccatcagcgtgtgtagtgatggtgcaattgtgggaacatccacattacagaatactcgaccatccatagtttcactatacgatggcgaagttgaaataccatctgcattttctctttctgttcagacggagtacttgcaagttcaagcagagcaagttatagttgattgtcctcagtatgtatgcaatggcaatagccgttgtctacaattactggcacaatacacctcagcttgctctaacattgaagcagctctgcattcctctgcacagttggatagcagagagattataaatatgtttcaaacatcaacacagtccttgcagttggctaatattaccaacttcaagggtgactacaattttagcagtatactaaccaccagaataggtggcagatctgctattgaagaccttctttttaataaagttgttactagtggccttggcactgttgatcaggactacaaagcctgctctagagacatggccatcgctgacttagtttgttcccagtattacaatggcatcatggttctacctggtgttgttgatgctgagaaaatggctatgtatactggctctattactggagctatggtatttgggggactgactgctgcagcggcaataccatttgccacggcagtactagcccgtctcaattatgtcgcactgcaaacaaatgtactacgagaaaaccagaaaattcttgcagaatcatttatccgagcagttggcaacatatcacttgcactatcttctgttaatgatgccatccagcaaacttctgaggctcttagcaccgtagctattgctattaaaaagattcgaacagttgttaaccagcagggcgaggcattatcacacctgactgcacagctgtcaaactattttcaagcaatttcgacttctattcaagacatttacaaccgtcttgacgaattagaggctatccagcaatttgaccggctcatcacaggacggttggctgcacttaatgcatatgttactcagttactcaatcagatgtctcagattaaacaatctcgattgttagctcagcaaaagattaatgagtgtgtcaaatctcagccgtccagatacgggttctggggaaatggcacacacatcttctcacatacacagactgcaccaaatggcatatttttcatgcatgcagtgctactacccaacaaattcacacgtgtcaacgcttctgtcggcatttgtggggataataccagaggctactcattgcagcctcaacttatactctaccagtttaataactcctggagagttacacctagaaatatgtatgaacccagactgccccggcaagctgatttcatacaattaactgattgcagcgttactttttacaacaccaccgctgctaatcttcccaatattattcctgacgttatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtagaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaaaaagaaaaggtataccgacgatcaaccaacaccgtcctttaagtttaaggaatggtagtcgacgactgggccgttaccatccctggacaatatattattgctatactagttgtcatctgcattggtgtggcactactttttattaacacttgcttagcttgtgttaaattattttacaagtgctacctaggggcagcataccttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaaggaggctatgccacgcgtaatcgtgtgatctatgttattaaacttattctgctttggctgctccaacccttcaccctagtggtgaccatttggaccgcagttgacagatcatctaagaaggacgcagttttcattgtgtccataatttttgccgtactgaccttcatatcctgggccaagtactggtatgactcaattcgcttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagttagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagctgcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggccgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggcactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgatttccaaccggagatggcccagcccaaggtttcagagttgaccccttcaacgctagaggaagacctcaggagcgtggaagtggcccaagatctcaatctgttaactccagaggcacaggcaatcagcccaggaaacgcgaccaatctgcacccgctgcggtacgtcgtaagacccaacatcaagctcccaagcggactttacccaagggtaaaaccatttctcaggtatttggcaaccggtttcgcactggtgccaatgtcggctctgcagacactgagaagacgggtatggctgatcctcgcatcatggctctagccagacatgtgcctggtgttcaggaaatgcttttcgctggccaccttgagagcaactttcaggcaggggcaattacccttaccttctcttactcaatcacagtcaaggagggttctcctgactatgagagacttaaggatgcgctcaatacggtcgttaaccagacctatgagccacccaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcactctatgtctgttaaacccacccaattccactcaaatatctctttggtttcagagagtcatagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 54 - DNA, 25420 bp, Porcine Deltacoronavirus
acatggggactaaagataaaaattatagcattagtctataattttatctccctagcttcgctagttctctaccgacaccaatccaggtgcgtctgccaccaagttggctaccctttctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgactaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcattcacgttgcagctgctgaagagggtcaccctaaggttactacttaccttggcaactataacctctatgccaccaaggctccgcctggcgtgcaggttcttagtgctaaaacctctcttactgactttgagaatgtctttggagcccaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtgaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcaccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtatgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcacaggcacctttcttctcacaaaggcaactactaagatactcaataaggcaaagtacatctttgatgtggagcctgagtacccagtagatgtaacaacatccaaagttgtagtacatgaagcactccagcaaatcgacactaagcctactagagctctagaggctgttgatgtcgttgttggtaatactgtactgcaaatggctactgatggcactgcgttctacccatcggatggtacgcacgcctctcttccaggattcaaagcaggctcggatgagcttttcataagcttcaactgcgacctctttgatgatgagactaatgctcaaatcaacgaaacactcgctgcatatgagcttaaccaactagtggctccaggtgattctacaccgcgtcaaattgcgacattggttgtcgatacacttgcagatgctataacagaccattttccggagaaaaccattgatctacctgaagactatcaagtcttttctgaccatggtgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggacccagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgttcgacgagccatttgttgatgctgagtctgatgatccacaagatcctgctgtatatgatgatacaacaattataacggacagcactgatgtaggcgatgagcctgagacaactctagctaccatcgttaacacacctccgacactcgataataacttgccacctgaagccattaaacaacccagcccgactaaggttgagttagttgttggtgaattggcaagtattaaatttgacaattctgtcctagtcaaccctgctaatgcgcaattaataaatggcggtggagctgcccgtgcaattgcaaaattagctggtccaaaataccaagagtactgtaatagtgtggctcctatctcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaatcatttgcaggtgtgggatgctctcaataggaccattgtacgcaccactactgactatgatcaagttaccaccaaggcccttacaccccagggagtgttggaagccaatctctttgatggtgaggactttgttcaagaaccaaaacccggtcaaatctaccttgaggttactgaagaaattcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatctcaatggtaatccaaacagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtacttctgcagatgaacctaccggtcctgccattaaatttgccgcagctcactgctggtacactaatggcaagaaaacagttaatggctatgacactaaagctaatgttgtagctacttatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattttagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttctgatagattatcagtccgcgctgatgatgactttctcagtgtactacttttataaggtaatgaagtttttccgccatctcacacatggatgtaaaattccaacgtgtatggtatgtgctaaacttcgtaccccacctactataacagttgagactgtcgttcaaggcaggaaatacccatctgttattgaaacaaatggcgggtttacaatttgtaaagaacacaacttctattgcaaagactgctctctacaaacacccggcactttcatcccgacagaagctattgagtcgctctcacgagctaccaggcttagtgtcgaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacccattgacaattatcaggaagttgcttctcgtattgagaagtattacccagttgcaaagattacacccacaggtgacatctttacagacattaagcaagcgaccaatggccaagctagtgactctgctattaatgcagctgttctggctgtccagcgcggtcttgattttacaattgacaaccctaacaatatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgctgttactccatctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgctcaaatgacaagtgctttgcaaataagtttttggcatttgatagcttcattcaagcaccttacactaattcacctgactgtccagtcgttgtgggagttgttgaagtaacgacgcactctattcctggaattccagcaggtgtcattcatagagacggtctcatacttaacatttatgaacagtctctttatgaaacccatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaacgcaaagtgcaccttcttacagtatcaggacactagacaactctattgctatgatactgttcctactgaacataagctttactctgatgtgcttccgcacgtcgagtataaggctattgacattaatggtgatcttgttcctttcaagataccggagcagataatgttctatccacatattgtgcgctatactagcaattcctattgccgtatggggcattgttttaatactaaccctggtatttgcatttcatttacggacgaatttccgtatagtgaaaatgttaaacccggtgtatactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtgggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggccttgtcatcttttcgtgaaggaggcggttcacagttgtacacaccacctaaatttgcagttgttcagagtcttaagaccaagctgcaagcaggtatcaaaatcctcctgcaccctccaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactatacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacctcccatgtgaacaaactaatatgtcctacattatgggactctcgcaaactgctcgagtccccgtagaacgtatcctcaataccattatacagctaaccaccaatagagatggtgcttgtattatgggatcttatgatttcgagtgtgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtacccaatagtactgccatgcttcactgtcgtggcattcctgttgactttaaccattaaacacactgttgtgtttaccactacatatttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttacaaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaacaatgagctatgtttgcgcaatgttttcactgctcagaacacagctcaggacttcaatggcaatgaatctactgtaaaatctttttatgttactagaaccggtaagaagattttggttgccattacatcaactaaagacaatcttaagactgtgacctgccttactgagaccggtaagacagtccttaacttggacccccctatgcgcttcgcacatactgtaggtggaaaacagtctgttgtctatctctattttattcagaatattagttcactcaacagaggtatggttattggccacatctctgaaactactattcttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggtcaattatgactgcacctgtggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaggaatgctacaacgctcttagtacagagctttatactactgatgatacatttggtatccttgccaaaactgagttcttcaagtttgacaagatacctaatgtcaatcgccagtatctgactaaatatacactcctggacttggcttatgctctacgtcatttgtcaacatctaaggacgttattcaagaaattttgatcaccatgtgcggaacccctgaagattggtttggggaaaattggtttgatccaattgagaacccatccttttacaaggagttccataaacttggagatattcttaaccgttgtgttcttaatgccaataagtttgctagtgcctgtatagacgctggtcttgttggcatattaacacccgataatcaagacctcctgggtcagatctatgactttggagattttattattacacaaccaggtaatggatgtgtggacctagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaacttggtatagtccttaaccaggacgttaccacacacatggcaaatattaatctaaacactctattgcgattggtaggtgatcccaccaccattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtaccttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatcagaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccccgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaactcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgactcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagatgttgaagcagcacacgccataaaacctaacaccgggactaacctgccattgcaaataggttttagtaccggaaagaatttttcagtcactccagagggaatttgggtaaacgagcacggatcttgcactgagcccgtccctgccaaaatacctcctggagaacaatttcgtcaccttaaaaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtgtggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgtttagctatccatgaactgttcagtactgttgactggaaccttgaatttccagtaactgctgagcaatcgcaacttaacaaggcctgtcgcttagtacaggcaaattacttaaatatactactcactacaaccaaagccacggtggttcacgatattggtgacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaatcgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactctaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtctataactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacattttctactacttgtacacagggtagaaatgttgagcagtttatacctaaaacacctatggaaagagacttccttgagatgtctcaacagtccttcatccagcaatatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatctaaagtattcactgtgtcaattgacaaccaacaaattagattcatgctttggcatgatgagcaagtcaagacttgctacccaatcttacagtcacttaccaatggttaccagatgccgtctgtgtacaaaacattggttactgacttacaaccagctgacatccctaattatcattcctacacccctcgggtgcctggagtagttaagaatgttatcaagtaccgacaacttttcaactacatagttaaaaaggataggttggcagtaccacacaatatgaccgtattacaccttggggctgcatctgcactaggtacagcaccaggttcttcagtcataaaacaaatgtttcctgaaggaactgttcttattgaccttgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagttaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcggacaacccggctacggcctgtaagctaaaagcaacgcctattatctcagctcgtgagttagagaagaagcctattcttcgctatctcgttgcatcaggacgccttcttgtgaggccaccagaatgcagagagctctattgattatgaccttactttgtctcgttcgagcaaagtttgctgatgatctactcgatttgctcaccttcccgggtgcacatcgcttcttacataaactcacgagtaattccagcagtctctactcgcgggctaataactttgatgttggcgttcttcctggctaccccactaagaacgttaacctattctcaccacttactaactctactttgccaattaatggccttcatcggagttaccaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgtagtgagcagtttaactataccactgcattacacaactctaccttcttctcacttaattctgagctttattgctttactaataacacctacttaggtattcttccacctgatttaactgactttacggtctatcgtactggtcagttttatgctaatggttaccttttaggtactttacctattacggttaactatgtaaggttgtatcggggtcatttgtcggccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactctgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaactcaactgaaaataataggtttactactaccattgtcacacctactttcttttattccacaaatgccaccaccttcaactgcaccaagcctgttttgtcctatggacccatcagcgtgtgtagtgatggtgcaattgcgggaacatccacattacagaatactcgaccatccatagtttcactatacgatggcgaagttgaaataccatctgcattttctctttctgttcagacggagtatttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagacttggtggcagatctgctattgaagaccttctttttaataaagttgttactagtggccttggcactgttgatcaggactacaaagcctgctctagagacatggccatcgctgacttagtttgttcccagtattacaatggcatcatggttctacctggtgttgttgatgctgagaaaatggcaatgtatactggctctcttactggagctatggtatttggaggactgactgccgcagcggcaataccatttgccacggcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggcgaggcattatcacacctgactgcacagctgtcaaacaattttcaagcaatttcgacttctattcaagacatttacaatcgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatctcagtcatccagatacggtttctgtggaaatggcacacacatcttctcacttacacagactgcaccaaatggcatatttttcatgcatgcagtgcttgtacccaacaaattcacacgtgtcaacgcttctgccggcatttgtgtggataatatcagaggctactcattgcagcctcaacttatactctaccagtttaataactcctggagagttacacctagaaatatgtatgaacccagactgccccggcaagctgatttcatacaattaactgattgcagcgttactttttacaacatcaccgctgctaatcttcccaatattatccctgacattatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaattatattgacaatcttaacaatactctagttgaccttgaatggctcaacagagtagaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaacacttgcttagcttgtgttaaattattttacaagtgctacctaggggcagcataccttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaaggaggctatgccacgcgtaatcgtgtgatctatgttattaaacttattctgctttggctgctccaacccttcaccctagtggtgaccatttggaccgcagttgacagatcatctaagaaggacgcagttttcattgtgtccataatttttgccgtactgaccttcatatcctgggccaagtactggtatgactcaattcgcttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagttagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggccgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaaaacccagcatcaagctcccaagcggactttacccaagggtaaaaccatttctcaggtatttggcaaccggtctcgcactggtgccaatgtcggctctgcagacactgagaagacgggtatggctgatcctcgcatcatggctctagccagacatgtgcctggtgttcaggaaatgcttttcgctggccaccttgagagcaactttcaggcaggggcaattacccttaccttctcttactcaatcacagtcaaggagggttctcctgactatgagagacttaaggatgcgctcaatacggtcgttaaccagacctatgagccacccaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagca

SEQ ID NO: 55 - DNA, 25420 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgactaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcattcacgttgcagctgctgaagagggtcaccctaaggttactacttaccttggcaactataacctctatgccaccaaggctccgcctggcgtgcaggttcttagtgctaaaacctctcttactgactttgagaatgtctttggagcccaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtgaccgatggtaaggctgaagcaattgcaaccaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcaccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagctctagaggctgttgatgtcgttgttggtaatactgtactgcaaatggctactgatggcactgcgttctacccatcggatggtacgcacgcctctcttccaggattcaaagcaggctcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccggtcggcaatgttgggattgacgacagcgcgtcggaaaagaagccaaatggggacccagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgaaggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgttcgacgagtcatttgttgatgctgagtctgatgatccacaagattctgctgtatatgatgatacaacaattataacggacagcactgatgtaggcgatgagcctgagacaactctagctaccatcgttaacacacctctgacactcgataataacttgccacctgaagccattaaacaacccagcccgactaaggttgagttagttgttggtgaattggcaagtattaaatttgacaattctgtcctagtcaaccctgctaatgcgcaattaacaaatggcggtggagctgcccgtgcaattgcaaaattagctggtccaaaataccaagagtactgtaatagtgtggctcctatctcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatctcaatggtaatccaaacagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtacttctgcagatgaacctaccggtcctgccattaaatttgccgcagctcactgctggtacactaatggcaagaaaacagttaatggctatgacactaaagctaatgttgtagctacttatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacgttgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcagtccgcgctgatgatgactttctcagtgtactacttttataaggtaatgaagtttttccgccatctcacacatggatgtaaaattccaacgtgtatggtatgtgctaaacttcgtaccccacctactataacagttgagactgtcgttcagggcaggaaatacccatctgttattgaaacaaatggcgggtttacaatttgtaaagaacacaacttctattgcaaggactgctctctacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaatatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgccgttactccatctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagtcgttgtgggagttgttgaagtaacgacgcactctattcctggaattccagcaggtgtcattcatagagacggtctcatacttaacatttatgaacagtctctttatgaaacccatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaacgcaaagtgcaccttcttacagtatcaggacactagacaactctattgctatgatactgttcctactgaacataagctttactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgttaaacccggtgtatactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtgggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaactgctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtacccaatagtactgccatgcttcactgtcgtggcattcctgttgactttaaccattaaacacactgttgtgtttaccactacatatttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttacaaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaacaatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggaccctcctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggtcaattatgactgcacctgtggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaggaatgctacaacgctcttagtacagagctttatactactgatgatacatttggtgtccttgccaaaactgagttcttcaagtttgacaagatacctaatgtcaatcgccagtatctgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggagatattcttaaccgttgtgttcttaatgccaataagtttgctagtgcctgtatagacgctggtcttgttggcatattaacacccgacaatcaagacctcctgggtcagatctatgactttggagattttattattacacaaccaggtaatggatgtgtggacctagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaacttggtatagtccttaaccaggacgttaccacacacatggcaaatattaatctaaacactctattgcgattggtaggtgatcccaccaccattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtaccttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatcagaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaataaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgccttccaatcactcactgacatgtcgtatgtaaataactttatgaatgaggccttttacgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgattcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaatctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgttgaagcagcacacgccataaaacctaacaccgggactaacctgccattgcaaataggttttagtaccggaaagaatttttcagttactccagagggaatttgggtaaacgagcacggatcttgcactgagcccgtccctgccaaaatacctcctggagaacaatttcgtcaccttaagaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgtttagctatccatgaactgttcagtactgttgactggaaccttgaatttccagtaactgctgagcaatcacaacttaacaaggcctgtcgcttagtacaggcaaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtctataactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaactctttgacaatcgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttatttgtacagcactgaccctaaatggcctcgccattgacggtgaagagctatacatatatgtacgctataacaatcaactgaccacattttctactacttgtacacagggtagaaatgttgagcagtttatacctaaaacacctatggaaagagacttccttgagatgtctcaacagtccttcatccagcaatatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacacccctcgggtgcctggagtagttaagaatgttatcaagtaccgacaacttttcaactacatagttaaaaaggataggttggcagtaccacacaatatgaccgtattacaccttggggctgcatctgcactaggtacagcaccaggttcttcagtcataaaacaaatgtttcctgaaggaactgttcttattgaccttgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagtcaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcaggacgccttcttgtgaggccaccagaatgcagagagctctattgattatgaccttactttgtctcgttcgagcaaagtttgctgatgatctactcgatttgctcaccttcccgggtgcacatcgcttcttacataaacccacgaggaattccagcagtctctactcgcgggctaataactttgatgttggcgttcttcctggctaccccactaagaacgttaacctcttctcaccacttactaactctactttgcccattaatggccttcatcggagttatcaaccactcatgctgaattgtcttactaaaataactaaccacactctcagcatgtatctcctacctagtgagatacaaacttatagctgcggcggtgccatggttaaataccagacacatgatgcagttcgtatcattttagacctcactgccactgaccacatctctgttgaagtcgttggccaacatggtgaaaattatgtgtttgtttgtagtgagcagtttaactataccactgcattacacaactctacctttttctcacttaattctgagctttattgctttactaataacacctacttaggtattcttccacctgatttaactgactttacggtctatcgtactgggcagttttatgctaatggttaccttttaggtactttacctattacggttaactatgtaaggttgtatcggggtcatttgtcggccaatattgcccactttgccctagcaaacctaaccgatacactcataacacttaccaatactactatatcgcaaatcacttattgtgataagtcagtagttgattcaatagcatgccagcgctcttctcacgaagtggaggatgggttttactctgaccctaaatctgccgttagagctaggcaacgtactattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagaaggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaactcaactgaaaataataggtttactactactattgtcacacctactttcttttattccacaaatgccaccaccttcaactgcaccaagcctgttttgtcctatggacccatcagcgtgtgtagtgatggtgcaattgcgggaacatccacattacagaatactcgaccatccatagtttcactatacgatggcgaagttgaaataccatctgcattttctctttctgttcagacggagtatttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagacttggtggcagatctgctattgaagaccttctttttaataaagttgttactagtggccttggcactgttgatcaggactacaaagcctgctctagagacatggccatcgctgatttagtttgttcccagtattacaatggcatcatggttctacctggtgttgttgatgctgagaaaatggcaatgtatactggctctcttactggagctatggtatttgggggactgactgctgcagcggcaataccattcgctacagcagtacaagctcgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggtgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatctcagtcgcccagatacggtttctgtggaaatggcacacacatcttctcacttacacagactgcaccaaatggcatatttttcatgcatgcagtgcttgtacccaacaaattcacacgtgtcaacgcttctgccggcatttgtgtggataataccagaggctactcattgcagcctcaacttatactctaccagtttaataactcctggagagttacacctagaaatatgtatgaacccagactgccccggcaagctgatttcatacaattaactgattgcagcgttactttttacaacacaaccgctgctaatcttcccaatattattcctgacgttatagatgtcaatcaaacagtcagtgatattattgacaatttacctacagcaacacctcctcagtgggatgttggtatttataacaacactattctcaacctcaccgttgagattaatgatctacaagagcggtctaaaaacctctcacagattgcagatcgtttacaaaattatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaacacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaaggaggctatgccacgcgtaatcgtgtgatctatgttataaaacttattctgctttggctgctccaacccttcaccctagtggtgaccatttggactgcagttgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagttagaaatccgccacaggatatggtaatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggccgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggcactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgatttccaaccggagatggcccagcccaaggtttcagagttgaccccttcaacgctagaggaagacctcaggagcgtggaagtggcccaagatctcaatctgttaactccagaggcacaggcaatcagcccaggaaacgcgaccaatctgcacccgctgcggtacgtcgtaagacccaacatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcttactcaatcacagtcaaggagggttctcctgactatgagagacttaaggatgcgctcaacacggtcgttaaccagacctatgagccacccaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacattaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagca

SEQ ID NO: 56 - DNA, 25420 bp, Porcine Deltacoronavirus
acatggggactaaagataaaaattatagcattagtctataattttatctccctagcttcgctagttctctaccgacaccaatccaggtgcgtctgccaccaagttggctaccctttctaggggcgcttttgcgcttgctcaccattagattacctggaaaccagccattcaggttggagtttccccaggcacttttgcgtgggcattagcggcttgtggtttttgcacaaaatctaagctacttaccgttcctctgaccattcaccacttctatagacagcactgactaccgtagggttcaagtcacaccggtctgcaccgcccgtcagcggacacattacccagcatagcactccttgcaccgagcctaggtaggataaaaccccctaccgggtgactcttaaggcctttcctccacgggatagctactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcattcacgttgcagctgctgaagagggtcaccctaaggttactacttaccttggcaactataacctctatgccaccaaggctccgcctggcgtgcaggttcttagtgctaaaacctctcttactgactttgagaatgtctttggagcccaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggcagattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtgaccgatggtaaggctgaagcaattgcaaccaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcaccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactggttgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgttccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgccggtaagcttattgtcgacactacaagtgtcatagctaaacttttccagccattctgtgattttatatcacctttccttcggaaagttgctggttttgcaatttacactgttggtaatcgcatgcttatgtttaccagcaccggcacctttcttcttacaagggcaactactaagatactcaataaggcaaagtacatctttgatgtggagcctgagtacccagtagatgtaacaacatccaaagttgtagtacatgaagcactccagcaaaccgacactaagcctactagagctctagaggctgttgatgtcgttgttggtaatactgtactgcaaatggctactgatggcactgcgttctacccatcggatggtacgcacgcctctcttccaggattcaaagcaggctcggatgagctttttataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgtagatgctataacagaccactttccggagaaaaccattgatctacctgaagactatcaagtcttttctgaccatgatgatctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgtcgacgtctatcctaaaccagagccagtcggcaatgttgggattgacgacagcgcgtcggaaaagaagccaaatggggactcagtaccggatcctgaggtccatccaacactagagagtgtggatgttgaacgaccaaccgaaacagcaaaccaggctgttgaagacaaaccttctgataccacctttgtggttgatgaggaacaattacaagaatcaacaccagaacatgaactccgctcctatgagggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgacgattcgtttgacgagtcatttgttgatgctgagtctgatgatccacaagatcctgctgtatatgatgatacaacaattataacggacagtactgatgtaggcgatgagcctgagacaactctagctaccatcgttaacacacctctgacactcgataataacttgccacctgaagccattaaacaacccagcccgactaaggttgagttagttgttggcgaattggcaagtattaaatttgacaattctgtcctagtcaaccctgctaatgcgcaattaacaaatggcggtggagctgcccgtgcaattgcaaagttagctggtccaaaataccaagagtactgtaatagtgtggctcctatctcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatttaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacttgtttcaaaacactgcttatcaatttagacctgctattgatgctctctatagggagtatctcaatggtaatccaaacagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtacttctgcagatgaacctaccggtcctgccattaaatttgccgcagctcactgctggtacactaatggcaagaaaacagttaatggctatgacactaaagctaatgttgtagctacttatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacattgagattttagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggtacgctaatagttactttctttgtgaacttctatggtgtgcaaataccattttatggtacacttctgatagattatcagtccgcgctgatgatgactttctcagtgtactacttttataaggtaatgaagtttttccgccatctcacacatggatgtaaaattccaacgtgtatggtatgtgctaaacttcgtaccccacctactataacagttgagactgtcgttcaaggcaggaaatacccatctgttattgaaacaaatggcgggtttacaatttgtaaagaacacaacttctattgcaaagactgttctctacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattaccattgatcaggcttattctagacccattgataattatcaggaagttgcttctcgtattgagaagtattacccagttgcaaagattacacccacaggtgacatctttacagacattaagcaagcgaccaatggccaagctagtgactctgctattaatgcagctgttctggctgtccagcgcggtcttgattttacaatcgacaaccctaacaatatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgtaacatgcgctgttactccatctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgctcaaatgacaagtgctttgcaaataagtttttggcatttgatagcttcattcaagcaccttacactaattcacctgactgtccagtcgttgtgggagttgttgaagtaacgacgcactctattcctggaattccagcaggtgtcattcatagagacggtctcatacttaacatttatgaacagtctctttatgaaatccatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaacgcaaagtgcaccttcttacagtaccaggacactagacaactctattgctatgatactgttcctactgaacataagctttactctgatgtgcttccgcacgtcgagtataaggctattgacattaatggtgatcttgttcctttcaagataccggagcagataatgttctatccacatattgtgcgctatactagcaattcctattgccgtatggggcattgttttaatactaaccctggtatttgcatttcatttacggacgaatttccgtatagtgaaaatgttaaacccggtgtatactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtgggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctgttgctgaatttgaccagtatctggcctcttacaacaagtacaaatatttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcaacaaacagcattccagtattacactgataatgttgttgctcaattatatgcacacttactgactgttgatgctagaccaaaatggctggcacaatctcagataagtatcgaggattttaactcatgggctgctaacaattcctttgctaacttcccatgtgaacaaactaatatgtcctacattatgggactctcgcaaactgctcgagtccctgtagaacgtatcctcaataccattatacagctaaccaccaatagagatggtgcttgtattatgggatcttatgatttcgagtgtgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtacccaatagtactgccatgctttactgtcgtggcattcctgttgactttaaccattaaacacactgttgtgtttaccactacatatttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttacaaacgatctgttgagatgaacgaatctccgcaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaacaatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggaccctcctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggtcaattatgactgcacctgtggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaggaatgctacaacgctcttagtacagagctttatactactgatgatacatttggtgtccttgccaaaactgagttcttcaagtttgacaagatacctaatgtcaatcgccagtatctgactaaatatacactcctggacttggcttatgctctacgccatttgtcaacatctaaggatgttattcaagaaattttgatcaccatgtgcggaacccctgaagattggtttggagaaaattggtttgatccaattgagaatccatccttttacaaggagttccataaacttggagatattcttaaccgttgtgttcttaatgccaataagtttgctagtgcctgtatagacgctggtcttgttggcatattaacacccgacaatcaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaacttggtatagtccttaacgaggacgttaccacacacatggcaaatattaatctaaacactctattgcgattggttggtgatcccaccaccattgcaagtgtctcagacaagtgtgtagatttaagaactccttgtcagaccttggctactatgtctagcggaattgctaaacagtcagtcaagcccgggcattttaatcaacacttctacaagtatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtatcttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggaattgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccccgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaactcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccgccaggcacaggtaagtcaacctttgctattggtttggctaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggacgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcgggtttctctactcagaccgttgactcttctcaaggttctgagtatgattatgttatcttttgcgtgaccactgactcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgttgaagcagcacacgccataaaacctaacaccgggactaacctgccattgcaaataggttttagtaccggaaagaatttttcagttactccagagggaatttgggtaaacgagcacggatcttgcactgagcccgtccctgccaaaatacctcctggagaacaatttcgtcaccttaagaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtgggggttctcgggacggctttccaccaaccatgacgcggtatgcacatatcatgctaatgcccatgttgcatcagctgatgcaatcatgacggtatgtttagctatccatgaactgttcagtactgttgactggaaccttgaatttccagtaactgctgagcaatcacaacttaacaaggcctgtcgcttagtacaggcaaattatttaaatatactactcactacaaccaaagccacggtggttcatgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaatgcccttgtgtgccgctacgatactcatcggcagaagcatttaattggacctaatggttcagcattatatgttaataagcatgcttttctcacccctgagatgcatacttatgctacacataaactcaacttggctccactcatctactactccaccacagattgtagtagtgaacagcctattgttgttacctacagagattgtgtcgcccggtgcaatactggaaaaactctctgtccaaatcatgctcttgaataccaagagtttatcaatgcatacaatctcatggctcgccatggatttaatgtttacataccacgcaatgtcaacgtctataactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaactttttgacaatcgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcattcaacaatatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatctaaagtattcactgtgtcaattgacaaccaacaaattagattcatgctctggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgactgtattacaccttggagctgcatctgcactaggtacagcaccaggttcttcagtcataaaacaaatgtttcctgaaggaactgttcttattgaccttgatataagagagttcacttcagacgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcggggtggttcgatgattatcaactattttgcacagcagtcaatgcctcgtcttcagaagcatttttatgctgttttaattatttggggcaagctaaggaaaacattaatggttttaacttacatgcttcctacattcaatggcgcaatgaaatagcattgacaccaacctattctcctttagcggacaacccggctacggcctgtaagctaaaagcaacgcctattatctcggctcgtgagttagagaagaagcctattcttcgctatctcgttgcatcaggacgccttcttgtgaggccaccagaatgcagagagctctattgattatgaccttactttgtctcgttcgagcaaagtttgctgatgatctactcgatttgctcacctttccgggtgcacatcgcttcttacataaacccacgaggaattccagcagtctctactcgcgggctaataattttgatgttggcgttcttcctggctaccccactaagaacgttaacctcttctcaccacttactaactccactttgcccattaatggccttcatcggagttatcaaccactcatgctgaattgtcttactaaaataactaaccacactctcagcatgtatctccaacctagtgatatacaaacctatagctgcggcggtgccatggttaaacaccagacacatgatgcagttcgtatcattttagacctcactgccactgaccacatctctgttgaagtcgttggccagcatggtgaaaattatgtgtttgtttgtagtgagcagtttaactataccactgcattacacaactctaccttcttctcacttaattctgagctttattgctttactaataacacctacttaggtattcttccacctgatttaactgactttacggtctatcgtactggtcagttctatgctaatggttaccttttaggtactttacctattacggttaactatgttaggttgtatcggggtcatttggcggccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactctgaccctaaatctgccgttagagctaggcaacgtactattgttacactacctaagctccctgagcttgaagtagtgcagttaaatatttctgcacacatggattttggcgaagccagacttgacagcgttaccattaacggtaacacatcctactgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttacagctgtagagggtcagactcacactggaaccacttcagtacatgcaacagacacttctagtgtaatcactgatgtctgcactgactacactatctatggagtctctggcactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgtcggtgctatcacatccagtaattcaactgaaaataataggtttactactactattgtcacacctactttcttttattccacaaatgccaccaccttcaactgcaccaagcctgttttgtcctatggacccatcagcgtgtgtagtgatggtgcaattgcgggaacatccacattacagaatactcgaccatccatagtttcactatacgatggcgaagttgaaataccatctgcattttctctttctgttcagacggagtatttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttggctaatattaccaacttcaagggtgactacaattttagcagcatactaaccaccagacttggtggcagatctgctattgaagaccttctttttaataaagttgttactagtggccttggcactgttgatcaggactacaaagcctgctctagagacatggccatcgctgacttagtttgttcccagtattacaatggcatcatggttctacctggtgttgttgatgctgagaaaatggcaatgtatactggctctcttactggagctatggtatttgggggactgactgctgcagcggcaataccattcgccacggcagtacaagcccgccttaattatgtcgcactgcaaacaaatgtactacaagaaaaccagaaaattcttgcagaatcatttaaccaagcagttggcaatatatcacttgcactatcctctgttaatgatgccatcaagcaaacttctgaggctcttaacaccgtagctattgctattaaaaagattcaaacagttgttaaccagcagggtgaggcattatcacacctgactgcacagctgtcaaacaattttcaggcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatctcagtcgtccagatacggtttctgtggaaatggcacacacatcttctcacttacacagactgcaccaaatggcatatttttcatgcatgcagtgcttgtacccaacaaattcacacgtgtcaacgcttctgccggcatttgtgtggataataccagaggctactcattgcagcctcaacttatactctaccagtttaataactcctggagagttacacctagaaatatgtatgaacccagactgccccggcaagctgattttatacaattaactgattgcagcgttactttttacaacaccacagctgctaatcttcccaatattattcctgacgttatagatgttaatcaaacagtcagtgatattattgacaatctacctacagcaacacctcctcagtgggatgttggtatctataataatactattctcaaccttaccgttgagattaatgatctacaagagcggtctaaaaacctctctcagattgcagatcgtttacaaaattatattgataatcttaataatactctagttgaccttgattggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgatgactgggccgttaccatccctggacaatatattattgctatactagttgtcacctgcattggtgtggcactactttttattaacacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcacttggcgtcatcctccaaggaggctatgccacgcgtaatcgtgtgatctatgttattaaacttattctgctttggctgctccaacccttcaccctagtggtgaccatttggaccgcagttgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagtcagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaacaaaaaggctactcatcctcagtttcgtggcaatggagttccgcttaactccgccatcaaacccgttgaaaaccatggctactggctgcgttacaccagacaaaagccaggtggtactccgattcctccatcctatgccttttattatactggcacaggtcccagaggaaatcttaagtatggtgaactccctcctaatgataccccagcaaccactcgtgttacttgggttaagggttcgggagctgacacttctattaagcctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcacccgctgcggtacgtcgtaagacccaacatcaagctcccaagcggactttacctaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcttactcaatcacagtcaaggagggttctcctgactatgagagacttaaggatgcgctcaacacggtcgttaaccagacctatgagccacccaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagca

SEQ ID NO: 57 - DNA, 25420 bp, Porcine Deltacoronavirus
acatggggactaaagataaaaattatagcattagtctataattttatctccctagcttcgctagttctctaccgacaccaatccaggtgcgtctgccaccaagttggctaccctccctaggggcgctttcgcgcttgctcaccattagatctacctggaaaccagccattcaggttggagtttccccaggctcttttgtgtgggcattagcggcttgtggtttttgcacaaaatctaagctacttaccgttcctctgaccatccaccacttctatagacagcactgactaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctattgcgttgcctgaaaatgtaccaccacctctgcaacttttcattcatgttgcggctgctgaagagggtcaccctaaggttactacttaccttggcaactataacctctatgccaccaaggctccgcctggcgtgcaggttcttagtgctaaaacctctcttactgactttgagaatgtctttggagctcaacccaccttgcgatcaattcgtaatctggtttgtgaggctcgctcggctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtaaccgatggtaaggctgaagcaattgcaactaagcctctgtctgctgccactaaaggcaagcaaatcacagaggatgtcaaccttctccctgactatcagcagctgtttgttgatcaagtgactggcactgaggttaaggttggagctctaacctatgttaagaccactgattcaccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtatctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaatcttgcagataactttactgcaataagtggtgttgtcactgcactcattcgcgaactccaggatcttaccctggatgtggcgacacgtatcactaatatacaatttgtttaccgtgccggtaagcttattgtcgacacgacaagtgtcatagctaaacttttccagccattttgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagatgtaacaacatccaaagttgtagtacatgaagcactccagcaaaccgacactaagcctactagagttctagaggctgttgatgtcgttgttggtaatactgtactgcaaatggctactgatggcactgcgttctacccatcggatggtacgcacgcctctcttccaggattcaaagcaggctcggatgagcttttcataagcttcaactgcgacctctttgatgatgagactaatgctcaaatcaacgaaacactcgctgcatatgagcttaaccaactagtggctccaggtgattctacaccgcgtcaaattgcgacgttggttgtcgatacacttgcagatgctataacagaccactttccggagaaaaccattgatctacctgaagactatcaagtcttttctgaccatgatgacctcccactcgcacaataccacatccctgatcacctgagcctgtatattcaggctatggaaggtgaagatgatagtggtgatgaaatatgtattgaggacgatgattacgactgtcctcaagccgacgaagacacagaaggagtaattccccaacagtgggaacttcctgatgttgataaatttttactcaagatccaggaacggaaaaccagcagcgacgaagtacttagcgtcgacgtctatcctaaaccagagccggtcggcaatgttgggattgacgacagcgcgtcggaaaagaagccaaatggggacccagtaccggatcttgaggttcatccaacactagagagtgtggatgttgaacgactaaccgaaacagcaaaccaggctgttgaagacaaaccttctgatactacctttgtggttgatgaggtacaattacaagaatcaacaccagaacctgaactccgctcctatgagggggagtttgattctgatgatgaaattattattcctatagtaccagtaacacctgcggatttaaaaccacagactattactataaaggagtactttaagtctgaaaaacttgagactattaacgaaggatccacagagtcagttacacaatctgatgattcatttgacgagtcatttgttgatgctgagtctgatgatccacaagaccctgctgtatatgatgatacaacaattataacggacagcactgatgtaggcgatgagcctgagacaactctagctaccatcgttaacacacctctgacactcgataataacttgccacctgaagccattaaacaacccagcccgactaaggttgagttagttgttggtgaattggcgagtattaaatttgacaattctgtcctagtcaatcctgctaatgcgcaattaacaaatggcggtggagctgcccgtgcaattgcaaaattagctggtccaaaatatcaagagtactgtaatagtgtggctcctatctcaggaccgcttaccacggattcttttgatgccaagaaacttggtgtagcctgcatcttgcatgtagtgccacccaaaggttctgaccctaatgtacaagaactcctgtatcaagcttacaagagtatccttactgaaccagcacattatgttatacctatactaggtgctggtatctttggatgcaacccagtccattctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatctcaatggtaacccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtacttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccacaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggtactcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcatgttttgacggtcaagactccctacatttgtatccgcatttacgtgttaatcagcatccccttcagaccactgactacactgtttatgcgctttcactaatactactattagctaacatgactcttgtcatgggcacgctaatagttactttctttgtgaacttctatggtgtgcaaataccattttatggtacacttttgatagattatcaatccacgctggtgatgactttctcagtgtactacttttataaggtaatgaagtttttccgccatctcacacatggatgtaaaattccaacgtgtatggtatgtgctaaacttcgtaccccacctactataacagttgagactgtcgttcagggcaggaaatacccatctgttattgaaacaaatggcgggtttacaatttgtaaagaacacaacttctattgcaaggactgctctctacaaacacccggcactttcatcccgacagaagctattgagtcgctctcacgagctaccaggcttggtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcttattctagacccattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaatatattaccacattatgcctttgacttctcaaccctcaatgcagaagaccaatctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgccgttactccatctacacttgttatgcgtgggaatattgcaacacagcccttgactcgcatcaaagctggtgcacctcccatgcgtcaaaaaattttatgtgttatcctggcacttgctattgtgtactttgcagctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagtcgttgtgggagttgttgatgtaacgacgcactctattcctggaattccagcaggtgtcattcatagagacggtctcatacttaacatttatgaacagtctctttatgaaacccatcagcgtcagtctatggttagggatgcgttgtcactcaagacagcaaatctctttaacctaggcaagcgtgttgtagtaggatacactcaacatgaagttgttgtgggtacatcctattttaattctcctgcactttttaatgcaaagtgcaccttcttacagtatcaggacactagacaactctattgttatgatactgttcctactgaacataagctttactctgatgtgcttccgcacgtcgagtataaggctattgacattaatggtgatcttgttcctttcaagataccagagcagataatgttctatccacacattgtgcgctatactagcaattcttattgccgtatggggcattgttttaatactaaccctggtatctgcatttcatttacggacgaatttccgtatagtgaaaatgtcaaacctggtgtatactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtgggcattgcacttatgtacaagtgccttgtcttcgcgattttctattatgcaatctacctttactttgtccttactttcccctcctttaagaggaatgtggcattgttttacttcgctgtagtgatcgtgccacacgtgagtaacatgcaattgcttgcgctcattgtgtgtagcattatttactttctctacacctatgttcatactgtagctaagacagctgggaaattttcttccttcttagacgcagctaaagctacttttgttattgacaatgaaaagtacgtgttgcttaaagaccttgctggtgctgaatttgaccagtatctggcctcttacaacaagtacaaatacttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcatccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcagcaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaactgctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtacccaatagtactgccatgctttactgttgtggcattcctgttgactttaaccattaaacacactgttgtgtttaccactacatatttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgttcaaaacaaaattcttgatgcaaaagctactgctgttgttgttgctaaccttctcgaaaaggctggcgtcacaaacaagcacgctgtttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttataaacgatctgttgagatgaacgaatctccacaggagcaaaagaaaaagcttaaagctgttaacattgcaaaggcggaatgggagcgtgaggctgcttctcagcgtaagcttgaaaagcttgctgatgctgctatgaagtctatgtaccttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaacaatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggaccctcctatgcgcttcgcacatactgtaggtggaaaacagtctgttgtctatctctattttattcagaatattagttcactcaacagaggtatggttattggccacatctctgaaactactatccttcaggcaagtggcactcaaattgagtaccagcaaaacgcctcccttttgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggtcaattatgactgcacctgtggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaggaatgctacaacgctcttagtacagagctttatactactgatgatacatttggtgtccttgccaaaactgagttcttcaagtttgacaagatacctaatgtcaatcgccagtatctgactaaatatacactcctggacttggcttatgctctacgtcatttgtcaacatctaaggatgttattcaagaaattttgatcaccatgtgcggaacccctgaagattggtttggggaaaattggtttgatccaattgagaacccatccttttacaaggagttccataaacttggagatattcttaaccgttgtgttcttaatgccaataagtttgctagtgcctgtatagacgctggtcttgttggcatattaacacccgataatcaagacctcctgggtcagatctatgactttggagattttattattacacaaccaggtaatggatgtgtggacctagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttatcatcctaacactgttgaatgtccagatgaccgttgcgtattgcactgtgcgaacttcaatgtgttgtttgctatgtgtatacctaacacggcatttggcaatctttgttcaagagctactgttgatggccaccttgtggtccagacagtgggtgtacacttgaaagaacttggtatagtccttaaccaggacgttaccacacacatggcaaatattaatctaaacactctattgcgattggtaggtgatcccaccaccattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtaccttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatcagaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcagacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccccgttcagaatcttgaacgttacatctcacttgcaattgatgcatatcccctcaccaaggttgaccctattaagggtaaagtcttttatttgttactagactacatacgtgtccttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaactcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatctattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaactattaaggcactcgaggagtctatcaagaagtcatacgctaccgcaaccgtcaaggatgtgtatgaccaacgcttcattaaacttctatgggaacagggtaaaaagccgccacccataacgaagaaccacatttttactggctaccattttaacaagaatggaaaagcccaagttggtgattacattcttgctaaaacagatggcagtgacacttatacctacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcatattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgactcagcacacgcacttaacatggctcgtttgaacgttgcccttacacgcgcaaagataggtatccttgtggtgtttagacaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccttcacttaaaattgatgcatatcataatatgttcctaacacgtgacgcgtgtcgcacctatgttcagagttggatcggcatagacgttgaagcagcacacgccataaaacccaacaccgggactaaccttccattgcaaataggttttagtaccggaaagaatttttcagttactccagagggaatttgggtaaacgagcatggatcttgcactgagcccgtccctgccaaaatacctcctggagaacaatttcgtcaccttaagaaggacatgcgccaggcgcgtccttggaaggttgttcgacgtgagattgctactcacattgctgatgtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgtttagctatccatgaactgttcagtactgttgactggaaccttgaatttccagtaactgctgagcaatcgcaacttaacaaggcctgtcgcttagtacaggcaaattacttaaatatactactcactacaaccaaagccacggtggttcacgatattggtaacccaaaaggtatccctatcgtgcgcaaacctggtgttaaatatcatttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctatgacactcatcggcagaagcatttaattggacctaatggttcagcattatatgttaataagcatgcttttctcacccctgagatgcatacttatgctacacataaactcaacttggctccactcatctactactctaccacagattgtagtagtgaacagcctattgttgttacctacagagattgtgtcacccggtgcaatactggaaaaactctctgtccaaatcatgctcttgaataccaagagtttatcaatgcatacaatctcatggctggccatggatttaatgtttacataccacgcaatgtcaacgtctataactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcttttgaacattacactaacaggcatacccgttcactgccaactacacagctgttatctggtttaggcgtaaccgccaccagaaatttcactgtgtggtttgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcatccagcaatatcaattgcaggaactgggtgttgaacacattatttatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtctgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcttacagtcacttaccaatggttaccagatgccatctgtgtacaaaacattagttactgacttacaaccagctgacatccctaattatcattcctacacccctcgggtgcctggagtagttaagaatgttatcaagtaccgacaacttttcaactacatagttaaaaaggataggttggcagtaccacacaatatgaccgtattacaccttggggctgcatctgcactaggtacagcaccaggttcttcagtcataaaacaaatgtttcctgaaggaactgttcttattgaccttgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagttaatgcctcgtcttcagaagcatttctatgctgttttaattatttggggcttgctaaggaaaacattaatggttttaacttacatgcttcctacattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcaggacgccttcttgtgaggccaccagaatgcagagagctctattgattatgaccttactttgtctcgttcgagcaaagtttgctgatgatctactcgatttgctaaccttcccgggtgcacatcgcttcttacataaactcacgagtaattccagcagtcactactcgcgggctaataactttgatgttggcgttcttcctggttaccccactaagaacgttaacctcttctcaccacttactaactctactttgccaattaatggccttcatcggagttaccaaccactcatgctgaattgtcttactaaaataactaaccacactctcagcatgtatctcctacctagtgagatacaaacttatagctgcggcggtgccatggttaaacaccagacacatgatgcagttcgtatcattttagacctcactgccactgaccacatctctgttgaagtcgttggccaacatggtgaaaattatgtgtttgtttgtagtgagcagtttaactataccactgcattacacaactctaccttcttctcacttaattctgagctttattgctttactaataacacctacttaggtatccttccacctgatttaactgactttacggtctatcgtactgggcagttttatgctaatggttaccttttaggtactttacctattacggttaactatgttaggttgtatcggggtcatttgtcggccaatagtgcccactttgccctagcaaacctaaccgatacactcataacacttaccaatactactatatcgcaaatcacttattgtgataagtcagtagttgattcaatagcatgccagcgctcttctcacgaagtggaggatgggttttactctgaccctaaatctgccgttagagctaggcaacgtactattgtcacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctatgtatggaattacttgctaaggcagcgtttgtatgttactgctgtagaaggccagactcacactggaaccacttcagtacatgcaacagacacttctagtgtaatcactgatgtctgcactgactacactatttatggagtctctggtactggcattattaagccatcagatctcttattgcacaatggcatagcattcacctctcccacaggtgagctttatgcatttaaaaatataaccactggcaaaacccttcaggtcttaccgtgtgaaaccccttctcaactgattgtgataaacaacaccgttgtcggtgctatcacatccagtaactcaactgaaaataataggtttactactactattgtcacacctactttcttttattccacaaatgccaccactttcaactgcaccaagcctgttttgtcctatggacccatcagcgtgtgtagtgatggtgcaattgcgggaacatccacattacagaatactcgaccatccatagtttcactatacgatggcgaagttgaaataccatctgcattttctctttctgttcagacggagtatttgcaagttcaagcagagcaagttatagttgattgtccacagtatgtatgcaatggcaacagccgttgtctacaattactggcacaatacacctcagcttgctctaacattgaagcagctctgcattcctctgcacagttggatagcagagagattataaatatgtttcaaacatcagcacagtccttgcagttagctaatattaccaacttcaagggtgactacaattttagcagcatactaaccaccagacttggtggcagatctgctattgaagaccttctttttaataaagttgttactagtggccttggcactgttgatcaggactacaaagcctgctctagagacatggccatcgctgacttagtttgttcccagtattacaacggcatcatggttctacctggtgttgttgatgctgagaaaatggcaatgtatactggctctcttactggagctatggtatttggaggattgactgccgcagcggcaataccatttgccacggcagtacaagcccgtctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggtgaggcattatcacacctgactgcacagctgtcaaacaattttcaagcaatttctacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcaacaaaagattaatgagtgtgtcaaatctcagtcgtccagatacggtttctgtggaaatggcacacatatcttctcacttacacagactgcaccaaatggcatatttttcatgcatgcagtgcttgtacccaacaaattcacacgtgtcaacgcttctgccggcatttgtgtggataataccagaggctactcattgcagcctcaacttatactctaccagtttaataactcctggagagttacacctagaaatatgtatgaacccagactgccccggcaagctgatttcatacaattaactgattgcagcgttactttttacaacaccaccgctgctaatcttcccaatattattcctgacgttatagatgttaatcaaacagtcagtgatattattgacaatttacctacagcaacacctcctcagtgggatgttggtatctataacaacactattctcaaccttaccgttgagattaatgatttacaagagcggtctaaaaacctttcacagattgcagatcgtttacaaaattatattgataatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactttttattaacacttgcttagcttgtgttaaattgttttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaaggaggctatgccacgcgtaatcgtgtgatctatgttattaaacttattctgctttggctgctccaacccttcaccctagtggtgaccatttggaccgcagttgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagttagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaagccggtgacgctcgcctgtataagtatatgtaatgtgcaactgccacttgcagctgcgagatttatatagattgtgcaataagcggcacatccgaagagaggatgttcctgagcttattgaccctctcgttaaaactcgttgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggctgcaccagtagtccctactactgacgcgtcttggtttcaggtgctcaaagctcaaaataaaaaggctactcatcctcagtttcgtggcaatggagttccgcttaactccgccatcaaacccgttgaaaaccatggctactggctgcgttacaccagacaaaagccaggtggtactccgattcctccatcctatgccttttattatactggcacaggtcccagaggaaatcttaagtatggtgaactccctcctaatgacaccccagcaaccactcgtgttacttgggttaagggttcgggagctgacacttctattaagcctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcacccgctgcggtacgtcgtaagacccaacatcaagctcccaagcggactttacccaagggtaaaaccatttctcaggtatttggcaaccggtctcgcactggtgccaatgtcggctctgcagacactgagaagacgggtatggctgatcctcgcatcatggctctagccagacatgtgcctggtgttcaggagatgcttttcgctggccaccttgagagcaactttcaggcgggggcaattacccttaccttctcttactcaatcacagtcaaggagggttctcctgactatgagagacttaaggatgcgctcaatacggtcgttaaccagacctatgagccacccaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaacctatgtctgttaaacccacccaactccactcaaatatctctttggttccagagagtcatagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 58 - DNA, 25420 bp, Porcine Deltacoronavirus; identical to SEQ ID NO: 57

SEQ ID NO: 59 - DNA, 25404 bp, Porcine Deltacoronavirus
acatggggactaaagataaaaattatagcattagtctataattttatctccctagcttcgctagttctctaccgacaccaatccaggtgcgtctgccaccaagttggctacccttcccaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgactaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcatccacgttgcagctgctgaagagggtcaccctaaggttactacttaccttggcaactataacctctacgctaccaaggctccgcctggcgtgcaggttcttagtgctaaaacctctcttactgattttgagaatgtctttggagctcaacccaccttgcgatcaattcgtaatctggtgtgtgaggctcgctcggctgaatggacaacttccaagaacgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacactgctaaaattggtacatctcttgctgacacgagatctgtctcacttattcataaggacgcctatctaactctcagtaacgaggttgttggcgtaacttttactgctgcacttatggcaaaggctaccactgttaatggagcaatgcaatactcaaacttttacctctaccctcgcgccactatcaaggtgaccgatggtaaggctgaagcaattgcaactaagcctctgcctgctgccactaaaggcaagccaatcacagaggatgtcaacctcctccctgactatcagcagctgcttgttgatcaagtgactggcactgaggttaaggttggagccttaacttatgttaagaccactgacctaccacccctttactttcccaaagttaaaggcggtgttgttggtattgcacttaagcagcagggcactgcggctaagaagctcaatgtagtctttcatgctcaacctgatgatgttctgctagctttcatacaacttcagcaattcttgaaccgcacttcggattcaagtgttgaaattactgattgccagagttatgaagtctctccaactgtgacggtaaaaattggcccgtctaaacctggagatgtcatcgtggctactgatgaggaataccttaaatgctttgaaacccccgaggtaggtaggctctataaggttttccaaactcaatcttgggctatcattgagcgttccttctccaggatccgcgtgtccaaagctttatcagcatttataagttttctgcaaaaccttgcagataactttactgcactaagtggtgttgtcactgcactcattcgtgaactccaggatctcaccctggatgtggcgacacgtatcactaacatacaatttgtttaccgcgctggtaagcttattgtcgacacgacaagtgtcatagctaaacttttccagccattttgtgattttatatcacctttccttcggaaagtggctggttttgcaatttacactgttggtaatcgcatgcttatgtttaccagcactggcacctttcttctcacaaaggcaactactaagatactcaataaggcaaagtacatctttgatgttgagcctgagtatccagtagctgtaacaacatctaaagttgtagtacatgaagcactccagcaaatcgacactaagcctgctagagctctagaggctgttgatgtcgttgttggtaacactgtactgcaaatggctactgatggcactgcgttctacccatcagatggtacgcatgcctctttaccaggattcaaagcaggttcggatgagcttctcataagcttcaactgcgacctctttgatgatgagactaatgctcaaatcaacgaaacactcgctgcatatgagcttaaccaactagtagctccaggtgattctacaccgcgtcaaattgcgacgttggttgtcgatacacttgtggatgctataacggaccactttccggagaaaaccattgatctacctgaagactatcaagtcttttctgaccatgatgacctcctacttgcacaataccacatccctgatcacctgagcctgtatattcaagctatggagggtgaggatgatagtggtgatgaaatatgtattgaggacgatgattacgactgtcctcaagccgacgaaaacacagaaggagtaattccccaacagtgggaacttcctgatgttgataaatttttactcacgatccaggaacggaagaccagcagcgacgaagtacttagcgttgacgtctatcctaaaccagatgaggttggggttgacgacagcgcgtcggaaaagaagccaaatggggacccagtaccggatcctgaggttcatccaacactagagagtgtggatgttgaacaaccaactgaaacagcaaaccaggctgttaaagacaaaccttctgataccacctttgtggttgatgaggaacaattacaagaatcaacaccagaacctgagctccgctcctatgaaggggagtttgattctgatgatgaaattattatccctatagtaccagtaacacctgcggatttaaaaccacagactattactataaaggagtactttaagtctgaaaaacttgagactattaacgaaggatctacagagtcggttgcacagtctgacgattcgttcgacgaatcatttgctgatgctgagtctgatgatccacaagaccctgctgtatatgatgatacaacaattataacggatagtactgatgtaggcgatgagcctgagacaactctagctaccatcgttaacacacctctgacactcgataataacttgccacctgaagccattaaacaacccagaccgactaaggttgagttagttgttggtgaattggcgagtattaaatttgacaattctgtcctagtcaaccctgctaatgcgcaattaacaaatggcggtggagctgcccgtgcaattgcaaaattagctggtccaaaatatcaagagtactgtaatagtgtggctcctatctcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacattatgttatacctatactaggtgctggtatctttggatgcaacccagtccactctctggatgcgttcaggaaagcatgtccaagtgacataggtcgtgtcacccttgtcactatgaacaaaaaccatttgcaggtgtgggatgctctcaataggaccattgtacgcaccactactgactatgatcaagttaccaccaaggcccttacaccccagggagtgttagaagccaatctctttgatggtgaggactttgttcaagaaccaaaacccggtcaaatctaccttgaggttactgaagaagttcagaaccaagccaaggaacttgaccttaaccttcagcaatactgcgtctacctgaagacttgccaccataaatgggttgtgagtcgtacgaacgggttgatgcatctaaaacaaaaagataacaattgttttgttagtgcaggtgtaaacctgtttcaaaacactgcttatcaacttagacctgctattgatgctctctatagggagtatctcaatggtaatccaaacagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgatgtgtggactccctttacaccccagagtggaaaaggtgcagttgcaattggtacttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccacaggatagtgtgctccatttggacccacctcctgtacaggccttacaacctaaggctaaccaacacattgagattctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcagtcgatcttacctgtaaatttgttagaacggtactcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcagtccgcgctgatgatgactttctcagtgtactacttttataaggtaatgaagtttttccgccatctcacacatggatgtaaaattccaacgtgtatggtatgtgctaaacttcgtaccccacctactataacagttgagactgtcgttcaaggcaggaaatacccatctgttattgaaacaaatggcgggtttacaatttgtaaagaacacaacttctattgcaaagactgctctctacaaacacccggcactttcatcccgacagaagctattgagtcgctctcacgagccaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaatatactaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgccgttactccatctacacttgttatgcgtgggaatattgcaacacagcccttgactcgcatcaaagctggtgcacctcccatgcgtcaaaaaattttatgtgttatcctggcacttgctattgtgtactttgctgctatggctttcggctttttggcaagtcaaattacgcttaatacagtgcctacgattaaatctgatatccgcgcctccaccttctacgttgttagagatggagtcttggatactgttcgttcaaatgacaagtgctttgcaaataagtttttggcatttgatagcttcattcaagcaccttacactaattcacctgactgtccagttgttgtgggagttgttgaagtaacgacgcactctattcctggaattccagcaggtgtcattcatagagacggtctcatacttaacatttatgaacagtctctttatgaaacccatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaacgcaaagtgcaccttcttacagtatcaggacactagacaactctattgctatgatactgttcctactgaacataagctttactctgatgtgcttccgcacgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggacgaatttccgtatagtgaaaatgttaaacctggtgtgtactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtgggcattgcacttatgtacaagtgccttgtcttcgcgattttttattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatacttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaacaacaaaactcatagtggtacagatcttgaaggtaacttctatggcccctatgtggatgaggaagttattcagcagcaaacagcattccagtattacactgataatgttgttgctcaattatatgcacacttactgactgttgatgctagaccaaaatggctggcacaatctcagataagtatcgaggatttcaactcatgggctgctaacaattcctttgctaacttcccatgtgaacaaactaatatgtcctacattatgggactctcgcaaactgctcgagtccctgtagaacgtatcctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtacccaatagtactgccatgcttcactgttgtggcattcctgttgactttaaccattaaacacactgttgtgtttaccactacatatttgcttccgtcacttttgatgatggttgtaaatgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgcgtaactctgcccattatcatgcctgacttagctattcgtgttttggcgtataacgtcattggctatgtcatatgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttcttgaaaaggctggcgtcacaaacaagcacgctatttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctatttcgacaacttgcttgagaacaaagctgttgttcaggctgttgccgatatcaacattaatctggattcttatagaatttataaggaggcagatgctatttacaaacgatctgttgagatgaacgaatctctacaggagcaaaagaaaaagcttaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaacaatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggaccctcctatgcgcttcgcacataccgtaggtggaaaacagtctgttgtctatctctattttattcagaatattagttcactcaacagaggtatggttattggccacatctctgaaactactatccttcaggcaagtggtactcaaattgagtaccagcaaaatgcctctcttctgacctatttggctttcgctgtagaccctaagacagcctaccttaagcatcttgctgatggtgggtctcctatacagggttgtattcagatgattgctactatgggtcctggatttgcagttactactaaaccacaacctaatgagcatcagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggtcaattatgactgcacctgtggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaggaatgctacaacgctcttagtacagagctttatactactgatgatacatttggtgtccttgccaaaactgagttcttcaagtttgacaagatacctaatgtcaatcgccagtatctgactaaatatacactcctggacttggcttatgctctacgtcatttgtcaacatctaaggacgttattcaagaaattttgatcaccatgtgcggaacccctgaagattggtttggagaaaattggtttgatccaattgagaacccatccttttacaaggagttccataaacttggagatattcttaaccgttgtgttcttaatgccaataagtttgctagtgcctgtatagacgctggtcttgttggcatattaacacccgacaatcaagacctcctgggtcagatctatgactttggagattttattattacacaaccaggtaatggatgtgtggacttagcatcctattattcttatttaatgcccattatgtccatgactcacatgttaaagtgtgagtgtatggatagtgatggcaacccacttgagtatgatggatttcagtatgacttcacggacttcaagcttggcttgttcgagaagtattttaagtactgggaccgtccttaccatcctaacactgttgaatgtccagatgaccgttgcgtattgcactgtgcgaacttcaatgtgttgtttgctatgtgtatacctaatacggcatttggcaatctttgttcaagagctactgttgatggccaccttgtggtccagacagtgggtgtacacttgaaagaacttggtatagtccttaaccaggacgtcaccacacacatggcaaatattaatctaaacactctattgcgattggtaggtgatcccaccaccattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtaccttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgataggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctaccgtttggctaatgaatgttgccaagtactatctgaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaagggctggagctgtcgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccctgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgctttccaatcactcactgacatgtcgtatgtaaataactttatgaatgaggccttttatgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatacgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaactccaaacaggtgatgttctagtcttaatggcacatgttgttacaccgctctcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggctaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgtttggtttacaatcacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgacttttatatctccatataatgctatgaatgtgaaagcatccttagcaggtttctctactcagaccgttgactcttctcaaggttctgagtatgattatgttatcttttgcgtgaccactgactcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgttgaagcagcacacgccataaaacctaacaccgggactaacctgccattgcaaataggttttagtaccggaaagaatttttcagttactccagagggaatttgggtaaacgagcacggatcttgcactgagcccgtccctgccaaaatacctcctggagaacaatttcgtcaccttaagaaggacatgcgccaggcgcgtccttggaaggttgttcgacgtgagattgctactcacattgctgaggtagctcctcacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgtttagctatccatgaactgttcagtactattgactggaaccttgaatttccagtaactgctgagcaatcgcaacttaacaaggcctgtcgcttagtacaggcaaattacttaaatatattactcactacaactaaaaccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcacccctgagatgcatacttatgccacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtctacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaactttttgacaatcgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacatttgctactatttgtacacagggtagaaatgttgagcagtttatacctaaaacacctatggaaagagacttccttgagatgtctcaacagtccttcattcaacaatatcaattgcaggaactgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaaccaacaaattagattcatgctttggcatgatgagcaagtcaagacttgctacccaatcctacagtcacttaccaatggttaccagatgccatctgtgtacaaaacattggttactgacttacaaccagctgacatccctaattatcattcctacacccctcgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgacctcgatataagagagttcacttcagatgctaaccaaataatagttacagactacagaacttacataccaccacaccacgtagacgtcatattttctgacctctactgttgtgatgacatacacttctttgacaatctaataaggatagttaaggagaggctcgccctcggtggttctatctttgttaagataactgaacattcattctcacccgaactctactcacttgcgggttggttcgatgattatcaactattttgcacagcagttaatgcctcgtcttcagaagcatttctatgctgttttaattatttggggcttgctaaggaaaacattaatggttttaacttacatgcttcctacattcaatggcgcaatgaaatagcgttgacaccaacctattctcctttagcggacaacccgactacggcctgtaagctaaaagcaacgcctattatctcggctcgtgagttagagaagaagcctattcttcgctatctcgttgcatcaggacgccttcttgtgaggccaccagaatgcagagagctctattgattatgaccttactttgtctcgttcgagcaaagtttgctgatgatctactcgatttgctcaccttcccgggtgcacatcgcttcttacataaacccacgagtaattccaccagtctctactcgcgggctaataactttgatgttggcgttcttcctggctaccccactaagaacgttaacctcttctcaccacttactaactctactttgccaattaatggccttcatcggagttatcaaccactcatgctgaattgttttactaaaataactaaccacactctcagcatgtatctccaacctagtgagatacaaacttatagctgcggcggtgccatggttaaataccagacacatgatgcagttcgtatcattttagacctcactgccactgaccacatctctgttgaagtcgttggccagcatggtgaaaattatgtgtttgtttgtagtgagcagtttaactacaccactgcattacacaactccaccttcttctcacttaattctgagctttattgctttactaataacacctacttaggtattcttccacctgatttaactgactttacggtctaccgtactggtcagttctatgctaatggttaccttttaggtactttacctattacggttaactatgttaggttgtatcggggtcatttgtctgccaatagtgcccactttgcccttgcaaacctaaccgatacactcataacacttaccaatactactatatcgcaaatcacttattgtgataagtcagtagttgattcaatagcatgccagcgctcttctcacgaagtggaggatgggttttactccgaccctaaatctgccgttagagctaggcaacgtactattgttacactacgtaagctccctgagcttgaagtagtgcagttaaatatttctgcacacatggattttggcgaagccagacttgacagtgtcaccattaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctcccacaggtgagctttatgcatttaaaaatataaccactggcaaaacccttcaggtcttaccgtgtgaaaccccttctcaactgattgtgataaacaacaccgttgtcggtgctatcacatccagtaactcaactgaaaataataggtttactactactattgtcacacctactttcttttattccacaaatgccaccaccttcaactgcaccaagcctgttttgtcctatggacccatcagcgtgtgtagtgatggtgcaattgtgggaacatccacattacagaatactcgaccatccatagtttcactatacgatggcgaagttgaaataccatctgcattttctctttctgttcagacggagtacttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttggctaatattaccaacttcaagggtgactacaattttagcagcatactaaccaccagaattggtggcagatctgctattgaagaccttctttttaataaagttgttactagtggccttggcactgttgatcaggactacaaatcctgctctagagacatggccatcgctgacttagtttgttcccagtattacaatggcatcatggttctacctggtgttgttgatgctgagaaaatggcaatgtatactggctctcttactggagctatggtatttggaggacttactgccgcagcggcaataccatttgccacggcagtacaagcccgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacaccgtagctattgctattaaaaagattcaaacagttgttaaccagcagggtgaggcattatcacacctgactgcacagctgtcaaacaattttcaagcaatttcgacttctattcaagacatttacaaccgtcttgaggaagtagaggctaaccagcaagttgaccgtctcatcacaggacggttggctgcacttaatgcatatgttactcagttactcaatcagatgtctcagattagacaatctcgattgttagctcagcaaaagattaatgagtgtgtcaaatctcagtcgtccagatacggtttctgtggaaatggcacacacatcttctcacttacacagactgcaccaaatggcatatttttcatgcatgcagtgcttgtacccaacaaattcacacgtgtcaacgcttctgccggcatctgtgtggataataccagaggctactcattgcagcctcaacttatactctaccagtttaataactcctggagagttacacctagaaatatgtatgaacccagactgccccggcaagctgatttcatacaattaactgattgcagcgttactttttataacaccaccgctgctaatcttcccaatattattcctgacgttatagatgtcaatcaaacagtcagtgatattattgacaatttacctacagcaacacctcctcagtgggatgttggtatctataacaacactattctcaacctcactgttgagattaatgatctacaagagcggtctaaaaacctctcacagattgcagatcgtttacaaaactatattgacaatcttaacaatactctagttgaccttgaatggctcaacagagtggaaacttaccttaaatggccgtggtatatatggcttgccattgccctggctcttattgcatttgtgacaatcctcataacaatctttctttgtactggttgttgtggtggttgctttggttgttgtggcggttgttttggccttttctctaagaagaaaagttataccgacgaccaaccaacaccgtcctttaagtttaaggaatggtagtcgacgactgggccgttaccatccctggacaatatattattgctatactagttgtcatctgcattggtgtggcactactctttattaacacttgcttagcttgtgttaaattattttacaagtgctacctaggggcagcataccttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaaggaggctatgccacgcgtaaccgtgtgatctatgttattaaacttattctgctttggctgctccaacccttcaccctagtggtgaccatttggaccgcagttgacagatcatctaagaaggacgcagttttcattgtgtccataatttttgccgtactgaccttcatatcctgggccaagtactggtatgactcaattcgcttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagttagaaatccgccacaggatatggtgatagtgtcgccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagctgcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggccgcaccagtagtccctactactgacgcgtcttggtttcacgtgctcaaagctcaaaacaaaaaggctactcatcctcagtttcgtggcaatggagttccgcttaactccgccatcaaacccgttgaaaaccatggctactggctgcgttacaccagacaaaagccaggtggcactccgattcctccatcctatgccttttattatactggcacaggtcccagaggaaatcttaagtatggtgaactccctcctaatgataccccagcaaccactcgtgttacttgggttaagggttcgggagctgacacttctattaaacctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcaccagctgcggtacgtcgtaagacccagcatcaagctcccaagcggactttacccaagggtaaaaccatttctcaggtatttggcaaccggtctcgtactggtgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcttactcaatcacagtcaaggagggttctcctgactatgagagacttaaggatgcgctcaatacggtcgttaaccagacctatgagccacccaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctgttaaacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctgattggagaaggccaaaggactgtactacttttgtaggtgtagcagtcgcccagtgggaaagcgccaactaggttacaattgtggtggggacaaattaggggaaattaaattggcttataggggggatggagc

SEQ ID NO: 60 - DNA, 25420 bp, Porcine Deltacoronavirus
acatggggactaaagataaaaattatagcattagtctataattttatctccctagcttcgctagttctctaccgacaccaatccaggtgcgtctgccaccaagttggctacccttcctaggggcgctttcgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgactaccgtagggtttaagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcattcacgttgcagctgctgaagagggtcaccctaaggttactacttaccttggcaactataacctctatgccaccaaggctccgcctggcgtgcaggttcttagtgctaaaacctctcttactgactttgagaacgtctttggagctcagcccaccttgcgatcaattcgtaatctggtgtgtgaggctcgctcagctgaatggacaacttccaagaatgcttttgcactcaaagccactcaacttgactactctgatgccgttttgagggcaatgattcgtttctgccctccaaaggtgtccacactcgctgcctttgctctttttggccgattggttaaaattgaggacaaggaacttgctgagttagctcgtgatactgcccttgagttggcgtacacggctaaaattggtacatctcttgctgacacgagatctgtctcacttattcataaggacgcttatctaactctcagtaatgaggttgttggcgtaacttttactgccgcacttatggcaaaggctaccactgttaatggagcaatgcaatactcaaacttttacctctaccctcgtgccactattaaggtgaccgatggtaaggctgaagcaattgcaactaagcctctgtctgctgccactaaaggcaagcaaatcacagaggatgtcaaccttctccctgactatcagcagctgcttgttgatcaagtgactggcactgaggttaaggttggagctctaacctatgttaagaccactgattcaccacccctttactttcccaaagtcaagggtggtgttattggtattgcacttaagcagcagggcactgcggctaagaagctcaatgtagtcttccatgctcaacctgatgatgttctgctagccttcatacaacttcagcaattcttgaaccgtacttcggattcaagtgttgaaattactgattgccagagttatgaagtctctccaactgtgacggtcaaaattggcccgtctaaacctggggatgtcatcgtggctactgatgaggaataccttaaatgctttgaaacccctgaggtaggtaggctctataaggttttccaaactcaatcttgggctatcattgagcgtgccttctccagtttgaagatccgcgtgtccaaagctttatcagcatttataagttttctgcaaaaccttgcagataactttactgcaataagtggtgttgtcactgcactcattcgtgaactccaggatcttaccctggatgtggcgacacgtatcactaacatacaatttgtttaccgtgctggtaagcttattgtcgacacgacaagtgtcatagctaaacttttccagccattctgtgattttatatcacctttccttcggaaagttgctggttttgcaatttacactgttggtaatcgcatgcttatgtttaccagcactggcacctttcttctcacaaaggcaactactaagatactcaataaggcaaagtacatctttgatgtggagcctgagtacccagtagctgtaacaacatccaaagttgtagtacatgaagcactccagcaaaccgacactaagcctactagagctctagaggctgttgatgtcgttgttggtaatactgtactgcaaatggctactgatggcactgcgttctacccatcggatggtacgcatgcctctcttccaggattcaaagcaggttcggatgagcttttcataagcttcaactgcgacctctttgatgatgaaactaatgctcaaatcaacgaaacactcgctgcatatgagcttaaccaactagtggctccaggtgattctacaccgcgtcaaattgcgacgttggttgtcgatacacttgcggatgctataacggaccactttccggagaaaaccattgatctacctgaagactatcaagtcttttctgaccatgatgacctcccactcgcacaataccacatccccaatcacctgagcctgtatattcaggctatggagggcgaggatgatagtggtgatgaaatatgtattgaggacgatgattacgactgtcctcaagccgacgaagacacagaaggagtaattccccaacagtgggaacttcctgatgttgataaatttttactcaagatccaggaacggaagaccagcagcgacgaagtacttagcgttgacgtctatcctagaccagagccggttggtaaggttgggattgacgacagcgcgtcggaaaagaagccaaatggggacccagtaccggatcctgaggttcatccaacactagagagtgtggatgttgaacaaccaaccgaaacagcaaaccaggctgttgaagacaaaccttctgataccacctttgtggttgatgaggaacaattacaagaatcaacaccagaacctgagctccgctcctatgagggggagtttgattctgatgatgaaattattatccctatagtaccagtaacacctgcggatttaaaaccacagactattactataaaggagtactttaagtctgaaaaacttgagactattaacgaaggatccacagagtcagttatacaatctgacgattcgttcgacgagtcatttgctgatgctgagtctgatgatccacaagatcctgctgtatatgatgatacaacaattataacagacagtactgatgtaggcgatgagcctgagacaactctagctaccatcgttaacacacctctgacactcgataataacttgccacctgaagccattaaacaacccagcccgactaaggttgagttagttgttggtgaattggcaagtattaaatttgacaattctgtcctagtcaaccctgctaatgcgcaattaacaaatggcggtggagctgcccgtgcaattgcaaaattagctggtccaaaataccaagagtactgtaatagtgtggctcctatctcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacctatactaggtgctggtatctttggatgcaacccagtccactctctggatgcgttcaggaaagcatgtccaagtgacataggtcgtgtcacccttgtcactatgaataaaaaccatttgcaggtgtgggatgctctcaataggaccattgtacgtaccactactgattatgatcaagtcaccaccaaggcccttacaccccagggagtgttagaagccaatctttttgatggtgaggactttgttcaagaaccaaaacccggtcaaatctaccttgaggttactgaagaagttcagaaccaagccaaggaacttgaccttaaccttcagcaatactgcgtctacctgaagacttgccaccacaaatgggttgtgagtcgtacgaatgggttgatgcatctaaaacaaaaagataacaattgttttgttagtgcaggtgtaaacctgtttcaaaacactgcttatcaacttagacctgctattgatgctctctatagggagtatctcaatggtaatccaaatagatttgttgcttggatctacgcatccactaaccgtcgtgttggtgagatgggttgtccacagcaagttatttctttgctcgttagtaactctgacgcagcattttcagcaactacagcctgttgtaacacctactttaaccacacaggtgttatttcagtagctcgtgaatatgacccaatacaaccaaaggtctactgcatgaagtgtgacgtgtggactccctttacaccccagagtggaaaaggtgcagttgcaattggtacttctgcagatgaacctaccggtcctgccattaaatttgccgcagctcactgctggtacactaatggcaagaaaacagttaatggctatgacactaaagctaatgttgtagctacctatcataggtttgacgtgcctaagcctcaacttgtcgaggacgtggttgcgctgcctactaaaaatgactttgaagttctcaatgttgaagaactgccgcaggatagtgtgctccatttggacccacctcctgtacaggccttacaacctaaggctaaccaacacgttgagactctagaaaacccagattatctggacattttggatctttggattcgtaaacccaaattcatcctcgtaaagtcgtggagtgttttgggtagagcactatgtaaggcaggtaaagttgtctttgtcagtgcttcgcttttgacccgtttctacaattaccttgtagagattggtgctcttgactcaacaataaggttgtcaatcgatcttacctgtaaatttgttagaacggttctcccatcgtctaacactgtacacaaaacttgtcttggtctgtattattcagcccagacactttttgtttctttagcaccattccttatgttaccagctgtagttagtctgcttaattcaggctatacaattggcacatatttgtatgcaaaaactggctggccttgtaattacaatgccacgcaacactttgattataattcttactgtgcaggtgacttggtttgtcaagcctgttttgacggtcaagactccctacatttgtatccgcatttacgtgttaatcagcagccccttcagaccactgactacactgtttatgcgctttcactaatactactattagctaacatgactcttgtcatgggcacgctaatagttactttctttgtgaacttctatggtgtgcaaataccattttatggtacacttttgatagattatcagtccgcgctggtgatgactttctcagtgtactacttttataaggtaatgaagtttttccgccatctcacacatggatgtaaaattccaacgtgtgtggtatgtgctaaacttcgtaccccacctactataacagttgagactgtcgttcagggcaggaaatatccatctgttattgaaacaaatggcgggtttacaatttgtaaagaacacaacttctattgcaaggactgctctctacaaacacccggcactttcatcccgacagaagctattgagtcgctctcacgagctaccaggcttagtgtcaaaccaacagcaccagcattcttacttgctagagatgttgagtgccaaactgatgttgtcgttgctcgcgcaatgcataaccaaaatgcgcatgtgtgcatttcaaaatactctgatatccgtaccgttgaccaactacttaagcctactccactgttttcatacactcccgatgttatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagatcacacccacaggtgacatctttacagacattaagcaagcgaccaatggccaagctagtgactctgctattaatgcagctgttctggctgtccagcgcggtcttgattttacaattgacaaccctaacaacatattaccacattacgcctttgacttttcaaccctcaatgcagaagaccagtctaccattttggagagtggttgtgctaaaggcaatctcaagggcactaatgttggtgttgttctttcagctagccttgttacacgtcttagtcagcaggctatacgtgtgattgctaatgctgcttcacgtaatggtgttacatgcgccgttactccatctacacttgttatgcgtgggaatattgcaacacagcccttgactcgcatcaaagctggtgcacctcccatgcgtcaaaaaattttatgtgttatcctggcacttgctattgtgtactttgctgctatggcttttggctttttggcaagtcaaattacgcttaatacagtgcctacgattaaatctgatatccgcgcctctaccttctacgttgttagagatggagtcttggatactgttcgttcaaatgacaagtgctttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaacccatcagcgtcagtctatggttagggatgcgttgtcactcaagacagcaaatctctttaacctaggcaagcgtgttgtagtaggatacactcaacatgaagttgttgtgggtacctcctattttaattctcctgcactttttaacgcaaagtgcaccttcttacagtatcaggacactagacaactctattgctatgatactgttcctactgaacataagctttactctgatgtgcttccgcgcgtcgagtataaggctattgacattaatggtgatcttgttcctttcaagataccagagcagataatgttctatccacatattgtgcgctatactagcaattcctattgccgtatggggcattgttttaatactaaccctggtatttgcatttcatttacggatgaatttccgtatagtgaaaatgtcaaacctggtgtatactgtgctgatacctctttgcagttgttttcaaacctcgttttgggcactgtatctggtattcacatctttacatcaacagctgcattgcttggatctactattgtgatcatactatgcgttgttgctgttcttgcagttcagcgattcttcaaggagtacacaacttttgttatgtacacttgtggtcttgctcttgtcaacattgtgggcattgcacttatgtacaagtgccttgtcttcgcgattttctattatgcaatctacctttactttgtccttactttcccctcctttaagaggaatgtggcattgttttacttcgctgtagtgatcgtgccgcacgtgagtaacatgcaattgcttgcgctcattgtgtgtagcattatctactttctctacacctatgttcatactgtagctaagacagctgggaaattttcttccttcttagacgcagctaaagctacttttgtcattgacaatgaaaagtacgtgttgcttaaagacctcgctggtgctgaatttgaccagtatctggcctcttacaacaagtacaaatacttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccttcaggtgtagttgagcgatgtatggtctcagttgtctacaatggatctgcattgaatggcatctggcttaagaatgttgtctactgcccacgccatgtaattggaaaattccgtggtgaccagtggactcacatggtctcaattgctgattgccgcgactttatagtcaagtgtccaatacagggtattcagctaaatgtccaatcagttaagatggtaggagctctcctccagttaactgttcataccaacaacacagccactccagactataagtttgaaaggctccaaccaggatcatcgatgacaattgcttgtgcttatgatggcattgtacggcatgtctatcacgtggtcctccaacttaataatcttatttatgcaagcttccttaacggagcttgtggtagtgtgggttacactcttaagggtaaaacactctacttacattacatgcaccacattgagtttaataacaaaactcatagtggtacagatcttgaaggtaacttctatggcccctatgtggatgaggaagttattcagcagcaaacagcattccagtattacactgataatgttgttgctcaattatatgcacacttactgactgttgatgctagaccaaaatggctgacacaatctcagataagtattgaggatttcaactcatgggctgctaacaattcctttgctaactttccatgtgaacaaactaatatgtcctacattatgggactctcgcaaactgctcgagttccggtagaacgtgttctcaataccattatacagctaaccaccaatagagatggtgcttgtattatgggatcttatgatttcgagtgcgattggacgccagagatggtatacaatcaggctccaatttcattgcagtcaggagtagttaagaaaacttgtacgtggttcttccacttcttgtttatggctattaccatgctactcgctgccatgcatgttttccctgtacacttgtacccaatagtactgccatgcttcactgtcgtggcattcctgttgactttaaccattaaacacactgttgtgtttaccactacatacttgcttccgtcacttttgatgatggttgtaaacgctaacactttttggataccgaacacatttctgcgcacctgctacgaaactatattcggttccccaattgctcagcgactgtatggttacactgttgctctttatatgctgatctatgctggacttgcaatcaactatacgttgaaaacactccggtatagagcaacttcattcttatctttttgcatgcagtggtttcaatatggttatgttgcacacattgcgtacaaactgcttaataaaccctggacagaatcactactcttcacagccttcacaatgctaaccagtcatcctttgttggctgctcttagctggtggctagctggtcgtgtaactctgcccattatcatgcctgacttagctattcgtgttttggcgtataacgtcattggctatgtcatgtgtgttcgatttggccttatgtggcttgcaaatcggttcacaactgtacctatgggcacataccagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttctcgaaaaggctggcgtcacaaacaagcacgctgtttgcaaaaagattgtgaaactccacaatgatacccttaaagccaccacttatgaggaggttgaggtagcacttgtgaaacttctttctcacataattgagttcttgccaactgatcaggtagatgcttatctagctgatgcggccaatgctcaacatgttaatacctattttgacaacttgcttgagaacaaagctgttgttcaggctgttgccgatatcaacattaatctggattcttatagaatttataaggaggcagatgctatttacaaacgatctgttgagatgaacgaatctccgcaggagcaaaagaaaaagctcaaagctgttaacattgcaaaggcggaatgggagcgtgaggctgcttctcagcgtaagcttgaaaagcttgctgatgctgctatgaagtctatgtatcttgcagaacgtgctgaggatcgtcgcattaagctaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagagggcaacacacttatacataagggagttcgctacactattgtgaagaaactctccttagataatgcacctattgaaggcgtaccagaagaattccctgtggtcgttgagactgttagggaaggtgtgccccagttgcaaaacaatgagctatgtttgcgcaatgttttcactgctcagaacacagctcaggacttcaatggcaatgaatccactgtaaaatctttttatgttactagaaccggtaagaagattttggttgccattacatcaactaaagacaatcttaagactgtgacctgccttactgagaccggtaagacagtccttaacttggaccctcctatgcgcttcgcacataccgtaggtggaaaacagtctgttgtctatctctattttattcagaatattagttcactcaacagaggtatggttattggccacatctccgaaactactatccttcaggcaagtggcactcaaattgagtaccagcaaaatgcctctcttttgacctatttggctttcgctgtagaccctaaaacagcctaccttaagcatctcgctgatggtgggtctcctatacagggttgtattcagatgattgctactatgggtcctggatttgcagttactactaaaccacaacctaatgagcaccagtattcttatggtggtgcttcaatttgtctttattgccgtgctcatataccacatcctggtgttgatggacggtgcccctacaaaggccgctttgttcacatcgacaaagataaggaacctgtttccttcgccttgactcatgagccatgcagttcttgtcaacggtgggtcaattatgactgcacctgcggatctagtctgcagaattcggcttatttaaacgagtaacgggttctagtgacgcccggctagaacccctgcagcctggaactcaaccagatgctgtaaaaagggccttccatgtgcataatgataccacctctggtatattcttaagcacaaaatctaactgcgctcggtttaaaaccacacgcagtgccctgcctttacctaacaagggagaggttgaattgtactttgttactaagcagtgtgcagctaaagtcttcgaaatcgaggaagaatgctataacgctcttagtacagagctttacactactgatgatacatttggtgtccttgccaaaactgagttcttcaagtttgacaagatacctaatgtcaatcgccagtatttgactaaatatacactcctggacttggcttatgctctacgtcatttgtcaacatctaaggatgttattcaagaaatcttgatcaccatgtgcggaacccctgaagattggtttggggaaaattggtttgatccaattgagaacccatccttttacaaggagttccataaacttggagatattcttaaccgttgtgttcttaatgccaataagtttgctagtgcctgtatagacgctggtcttgttggcatattaacacccgacaatcaagacctcctgggtcagatctatgactttggagattttattattacacaaccaggtaatggatgtgtggacctagcatcctattattcttatttaatgcccattatgtccatgactcacatgttaaagtgtgagtgtatggatagcgatggcaacccacttgagtatgatggatttcagtatgacttcacggacttcaagcttggcttgttcgagaagtattttaagtactgggaccgtccttaccatcctaacactgttgaatgtccagacgaccgttgtgtattacactgtgcgaacttcaatgtgttgtttgctatgtgtatacctaatacggcatttggcaatctttgttcaagagccactgttgatggccaccttgtggtccagacagtgggtgtacacttgaaagaacttggtatagtccttaaccaggacgttaccacgcacatggcaaatattaatctaaacactctattgcgattggtaggtgatcccaccaccattgcaagtgtctcagacaagtgtgtagatttaagaactccttgtcagaccttggctactatgtctagcggaattgctaaacagtcagtcaagcccgggcattttaatcaacacttctacaagcatttgcttgatagtaacctattagaccaacttggaatagacattcgccacttctactatatgcaggatggtgaagcggctatcacagactacagctactacaggtataatacccccacgatggtagatatcaagatgttcttattttgccttgaggtggcagataagtaccttgagccctacgaaggtggatgtattaatgcacagtcagttgtggtctctaatttggacaagtcagcgggctacccctttaacaagctaggtaaggctcgtaactattacgacatgactcatgccgagcaaaatcaactgtttgagtatacaaaacgcaatgttttgcctacactcactcagatgaaccttaagtatgcaatttcagccaaggatcgtgctcgcactgtggcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaacaatcccattttagtgggttgggattaccctaagtgtgatcgttctatgccaaacatgctgcgcattgccgcttcgtgcttgctagcacgaaaacacacttgctgtaaccaaagccagcgattctatcgtttggctaatgaatgttgccaagtactatcagaagtggtagtctctggtaacaacctctatgtaaaaccaggtggcactagcagtggtgatgcaaccacagcttatgccaactcggtatttaacatcttacaggtggtttctgctaatgtagccaccttcttatcaacttccaccacgacacatcttaataaggacattgcggacttgcatcgtagtctttatgaagatatttatcgtggtgactctaatgatatcaccgtcatcaatagattctaccagcatctccaaagttactttggacttatgatattgtctgatgatggtgtcgcatgcatagactcagccgttgcaaaggctggagctgttgctgatcttgatggtttccgagacattttgttttaccaaaacaatgtttacatggcagactcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccccgttcagaaccttgaacgttacatctcacttgcaattgatgcatatcccctcaccaaggttgaccctattaagggtaaagtcttttatttgttactagactacatacgtgttcttgctcaggagttacaggacggtatccttgatgccttccaatcactcactgacatgtcgtatgtaaataactttatgaatgaggccttttacgctcagatgtatgagcaaagtcctacactacaggccagcggtgtttgtgtggtgtgtaattcacccactatactgcgctgtggtgattgcattcgtcgaccactactttgttgcgtctgtgcctaccagcatgttacgcagactacacataaacgtatcattgctatcaacaactacatttgtagtgttgagaattgcaatgaggacaatgttgaaaaacttttcatttctggcactgcgatttattgtgagaatcacaaacccacgctgtgcatacccattgtagctaatggttctgtttttggtatctatcgccacactgcccgtggtagtgatgacatagacctctttaacgagcttgctacatctaactatgacactattgaaccttatcagaaggccaatcgtgcacctttatcacttatgctcttcgctgctgaaaccattaaggcactcgaggagtctatcaagaagtcatatgctaccgcaaccgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaacttcaaacgggtgatgttctagtcttaatggcacatgttgttacaccgctttcagcaccccctgtgctaacgcagacaacatatgtcagaaaatcacttttacccgactctgttggtgcgtcttattatgtgcaacattttaagtcatataatgagatagctatgcagagggttacaacagtattaggtccaccaggcacaggtaagtcaacctttgctattggtttggcaaagtactttcctagtgcacgtatttgctacactgcgtcttcgcatgcagcaatcgatgcactctgtgaaaaagctttcaagacaatacctgtaggccaatgcagtcgtatcgtacccacacgtacaactgttgagtgctttcaggagtttgtcgtaaataacacaactgcacagtatatcttctcgactatcaatgccttacctgacattaagtgtgacattgtagttgtagatgaggtttctatgttgaccaattatgagctttcctctgtgaatgctcgcttggtttacaaccacattgtgtatgttggtgatccttatcagttaccttcacctagaactatgcttacgtctggccagctttcgccagctgactataacgtagttactgatataatggtacatgcaggagcggatgttatgctcgacatgtgctacagatgcccacgtgaaatcgttgagacagtgtctaaacttgtctacgataacaaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcagaccgttgactcttctcaaggttctgagtatgattatgttatcttttgcgtgaccactgactcagcacacgcacttaacatggctcgtttgaacgttgcccttacacgcgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgttgaagcagcacacgccataaaacctaacaccgggactaacctgccattgcaaataggttttagtaccggaaagaatttttcagttactccagagggaatttgggtaaacgagcacggatcttgcactgagcccgtccctgccaaaatacctcctggagaacaatttcgtcaccttaagaaggacatgcgccaggcgcgtccttggaaggttgttcgacgtgagattgctactcacattgctgaggtagctcctcacactgattatatatgctttgtcacttgggctcaccagcttgagttagcgacaatgcgctactttgtcaaattaggtatggaagagaaatgcttttgtggcaggcgggcttgtttcactaatggaactgagttcgcttgcaaagcacaccattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgtttagctatccatgaactgttcagtactgttgactggaaccttgaatttccagtaactgctgagcaatcacaacttaacaaggcctgtcgcttagtacaggcaaattacttaaatatactactcactacaaccaaagccacggtggttcacgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacgcataccctgctaatgcccttgtgtgccgctacgacactcatcggcagaagcatttaattggacctaatggttcagcactatatgttaataagcatgcttttctcacccctgagatgcatacttatgctacacataaactcaacttggctccactcatctactactccaccacagattgtagtagtgaacagcctattgttgttacctacagagattgtgtcacccggtgcaatactggaaaaactctctgtccaaatcatgctcttgaataccaagagtttatcaatgcatacaatctcatggctcgccatggatttaatgtttacataccacgcaatgtcaacgtctacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcctttgaacattacactaacaggcatacccgttcactgccaactacacagctgttatctggtttaggcgtaaccgccaccagaaatttcactgtgtggttcgacaatgatacaattttccaatacactattaatgtatctacgtatactgacatcgaccctagtacccatgttgtcctctgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacatttgctactacttgtacacagggtagaaatgttgagcagtttatacctaaaacacctatggaaagagacttccttgagatgtctcaacagtccttcattcaacaatatcaattgcaggacctgggtgttgaacacattatctatggtgatgattccagtccagtcattggcggaactcacacacttatctcactagttaaaaacaagtttgaacatcagcttgtcaaccatgtttacaacccagtccagaactgtgttgttacctcacctaacgcaagctccaagaacgtttgcactgttcttgatgttcttcttgatgactacattgacatcataagacaagcacatgccagttacacaagtaaatccaaagtattcactgtgtcaattgacaatcaacaaattagattcatgctttggcatgatgagcaagtcaagacttgctacccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactacatagttaaaaaggataggttggcagtaccacacaatatgaccgtattacaccttggagctgcatctgcactaggtacagcaccaggttcttcagtcataaaacaaatgtttcctgaaggaactgttcttattgaccttgatataagagagttcacttcagatgctaaccaaataatagttacagactacagaacttacatgccaccacaccacgtagacgtcatattttctgacctctactgttgtgatgacatacacttctttgacaatctaataaggatagttaaggagaggctcgccctcggtggttctatctttgttaagataaccgaacattcattctcacccgaactctactcacttgcggggtggttcgatgattatcaactattttgcacagcagtcaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcggacaacccggctacggcctgtaagctaaaagcaacgcctattatctcggctcgtgagttagagaagaagcctattcttcgctatctcgttgcatcaggacgccttcttgtgaggccaccagaatgcagagagctctattgattatgaccttactttgtctcgttcgagcaaagtttgctgatgatctacttgatttgctcacctttccgggagcacatcgcttcttacataaacctacgaggaatgccagcagtccctactcgcgggctaataataattttgatgttggcgttcttcctggctaccccactaagaacgttaacctcttctcaccacttactaactctactttgcccattaatggccttcatcggagttatcaaccactcatgctgaattgtcttactaaaataactaaccacactctcagcatgtatctccaacctagtgagatacaaacttatagctgcggcggtgccatggttaaataccagacacatgatgcagttcgtatcattttagacctcactgccactgaccacatttctgttgaagtcgttggccaagatggtgaaaattatgtgtttgtttgtagtgatcagtttaactataccactgcattacacaactctacctttttctcacttaattctgagctttattgctttactaataacacctacttaggtattcttccacctgatctaactgactttacggtctatcgtactggtcagttctatgctaatggttaccttttaggtactttacctattactgttaactatgttaggttgtatcggggtcatttgtcggccaatagtgcccactttgcccttgcaaacctaaccgatacactcataacacttaccaatactactatatcgcaaatcacctattgtgataagtcagtagttgattcaatagcatgccagcgctcttctcatcaagtggaggatgggttttactctgaccctaaatctgccgttagagctaggcaacgtacaattgttacactacctaagctccctgagcttgaagtagtgcagttaaatatttctgcacacatggattttggcgaagccagacttgacagcgttaccatcaatggtaacacatcctattgtgtcactaagccttacttcaggcttgaaactaactttatgtgtacaggttgcactatgaatctgcgcactgatacctgtagttttgacctgtcagcagtaaacaatggcatgtcattctctcaattctgtctaagcactgaatctggtgcttgtgagatgaaaattattgttacctacgtatggaattacttgctaaggcagcgtttgtatgttactgctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctctccaacaggtgagctttatgcatttaaaaatataaccactggcaaaacccttcaggtcttaccgtgtgaaaccccttctcaactgattgtgataaacaacaccgttgttggtgctatcacatccagtaattcaactgaaaataataggtttaccactactattgtcacacctactttcttttattccacaaatgccaccaccttcaactgcactaagcctgttttgtcctatggacccatcagcgtgtgtagtgatggtgcaattgcgggaacatccacattacagaatactcgaccatccatagtttcactatacgatggcgaagttgaaataccatctgcattttctctttctgttcagacggagtatttgcaagttcaagcagagcaagttatagttgattgtcctcagtatgtatgcaatggcaacagccgttgtctacaattactggcacaatacacctcagcttgctctaacattgaagcagctctgcattcctctgcacagttggatagcagagagattataaatatgtttcaaacatcaacacagtccttgcagttagctaatattaccaacttcaagggtgactacaattttagcagcatactaaccaccagagttggtggcagatctgctattgaagaccttctttttaataaagttgttactagtggccttggcactgttgatcaggactacaaatcctgctctagggacatggccatcgctgacttagtttgttcccagtattacaatggcatcatggttctacctggtgttgttgatgctgagaaaatggcaatgtatactggctctcttactggagctatggtatttgggggactcactgctgcagcggcaataccattcgccacggcagtacaagcccgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggcccttaacactgtagctattgctattaaaaagattcaaacagttgttaaccagcagggtgaggcattatcacacctgactgcacagctgtcaaacaattttcaagcaatttcgacttctattcaagacatttacaaccgtcttgaggaagtagaggctaaccagcaagttgaccgtcttatcacaggacggttggctgcacttaatgcatatgttactcagttactcaatcaaatgtctcagatcagacaatctcgattgttagctcagcaaaagattaatgagtgtgtcaaatctcagtcgtccagatacggtttctgtggaaatggcacacacatcttctcacttactcagactgcaccaaatggcatatttttcatgcatgcagtacttgtacccaacaaattcacacgtgtcaacgcttctgcgggcatttgtgtggataataccagaggctactcattgcagcctcaacttatactctaccagtttaataactcctggagagttacacctagaaatatgtatgaacccagactgccccggcaggctgatttcatacaattaactgattgcagcgttactttttataacaccaccgctgctaatcttcccaatattatccctgacgttatagatgtcaatcaaacagtcagtgatattattgacaatttacctacagcaacacctcctcagtgggatgttggtatctataacaacactattctcaacctcaccgttgagattaatgatctacaagagcggtctaaaaacctctcacagattgcagatcgtttacaaaactacattgacaatcttaacaatactctagttgaccttgaatggctcaacagagtggaaacttaccttaaatggccgtggtatatatggctagccattgccctggctcttattgcatttgtgacaatcctcataacaatctttctttgtactggttgttgtggtggttgctttggttgttgtggcggttgttttggccttttctctaagaagaaaaggtataccgacgaccaaccaacaccgtcctttaagtttaaggaatggtagtcgacgactgggccgttaccatccctggacaatatattattgctatactagttgtcatctgcattggtgtggcactactctttattaacacttgcttagcttgtgttaaattattttacaagtgctacctaggggcagcatatcttgtcaggcctattatagtgtactactccaagccgaaccccgtacctgaggatgagtttgtaaaagtacaccaatttcctagaaacactcactatgtctgatgcggaagagtggcaaattattgttttcattgcgatcatatgggcgcttggcgtcatcctccaaggaggctatgccacgcgtaatcgtgtgatctatgttattaaacttattctgctttggctgctccaacccttcaccctagtggtgaccatttggaccgcagttgacagatcatctaagaaggacgcagttttcattgtgtccataatttttgccgtactgaccttcatatcctgggccaagtactggtatgactcaattcgtttattaatgaaaaccagatctgcatgggcactctcacctgagagtagactccttgcagggattatggatccaatgggtacatggaggtgcattcccatcgaccacatggctccaattctcacaccagtcgttaagcatggcaagctcaagctacatgggcaagagctggccaatggcatatcagttagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagaggatgttcctgagcttattgaccctctcgttaaaactcgctgttttgcttacagtctcgtggttcttgctaatgctaatccaattgcatttagcatactacctcggaaaattcttatcaatggtgagcctttactgcttgaatatggtagcatatatggtaaagactttatcattcgaccatcgctccaagtcattcttgaagatgaattaaattaaagttttgacaccaatctatcatggccgcaccagtagtccctactactgacgcgtcttggtttcaggtgctcaaagctcaaaacaaaaaggctactcatcctcagtttcgtggcaatggagttccgcttaactccgccatcaaacccgctgaaaaccatggctactggctgcgttacaccagacaaaagccaggtggtactccgattcctccatcctatgccttttattatactggcacagggcccagaggaaatcttaagtatggtgaactccctcctaatgataccccagcaaccactcgtgttacttgggttaagggttcgggagctgacacttctattaagcctcatgttgccaaacgcaaccccaacaatcctaaacatcagctgctacctctccgattcccaaccggagatggcccagctcaaggtttcagagttgaccccttcaacgctagaggaagacctcaggagcgtggaagtggcccaagatctcaatctgttaactccagaggcacaggcaatcagcccaggaaacgcgaccaatctgcacctgctgcggtacgtcgtaagacccaacatcaagctcccaagcggactttacccaagggtaaaaccatttctcaggtatttggcaaccggtctcgtactggtgccaatgtcggttctgcagacactgagaagacgggtatggctgatcctcgcatcatggctctagccagacatgtgcctggtgttcaggaaatgcttttcgctggccaccttgagagcaactttcaggcgggggcaatcaccctgaccttctcttactcaatgacagtcaaggagggttctcctgactatgagagacttaaggatgcgctcaacacggtcgttaatcagacctatgagccacccaccaaaccaactaaggacaagaagcctggcaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctctacccacccaactccactcaaatatctctttggttccagagagtcgtagtgtatagccagagagccagtcagagggcgctatcatgcaaactagggctggctactctagcacagaatcacatcccgataatcaacagtgctagaaggttgattataccatttaatatgccgaggccacgcggagcacgatcgagggtacagcataatctcaacttttgttgagccacaattttaatcctaattggagaaggccaaaggactgtactacttttgtaggtgtagcagtcgcccagtgggaaagcgccaactaggttacaattgtggtggggacaaattaggggaaattaaattggcttataggggggatggagca

SEQ ID NO: 61 - DNA, 25405 bp, Porcine Deltacoronavirus
acatggggactaaagataaaaattatagcactagtctataattttatctccctagcttcgctagttctctaccgacaccaatccaggtgcgtttgccaccaagttggctacccttaggggcgcttttgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttagtcacaccggtttgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcattcacgttgcagctgctgaagagggtcaccctaaggttactacttaccttggcaactataacctctacgccaccaaggctccgcctggcgtgcaggttcttagtgctaaaacctctcttactgattttgagaatgtctttggagctcaacccaccttgcgatcaattcgtaatctggtgtgtgaggctcgctcagctgaatggataacttccaagaatgcttttgcactcaaagccactcaacttgactactctgatgccgttttgagggctatgattcgtttctgccctccaaaggtgtccacactcgctgcctttgctctttttggccgattggttaaaattgaggacaaggaacttgctgagttagcttgtgatactgcccttgagttggcatacactgctaaaattggtacatctcttgctgacacgagatctgtctcacttattcataaggacgcctatctaactctcagtaacgaggttgttggcgtaacttttactgccgcacttatggcaaaggctaccactgttaatggagcaatgcaatactcaaacttttacctctaccctcgcgccactatcaaggtgaccgatggtaaggctgaagcaattgcaactaagcctctgcctgctgccactaaaggcaagccaatcacagaggatgtcaacctcctccctgactatcagcagctgcttgttgatcaagtgactggcactgaggttaaggttggagccttaacttatgttaagaccactgacctaccacccctttactttcccaaagttaaaggcggtgttgttggtattgcacttaagcagcagggcactgcggctaagaagctcaatgtagtcttccatgctcaacctgatgatgttctgctagctttcatacaacttcagcaattcttgaaccgtacttcggattcaagtgttgaaattactgattgccagagttatgaagtctctccaactgtgacggtaaaaattggcccgtctaaacctggagatgtcatcgtggctactgatgaggaataccttaaatgctttgaaacccccgaggtaggtaggctctataaggttttccaaactcaatcttgggctatcattgagcgttccttctccaggatccgcgtgtccaaagctttatcagcatttataagttttctgcaaaaccttgcagataactttactgcactaagtggtgttgtcactgcactcattcgtgaactccaggatctcaccctggatgtggcgacacgtatcactaacatacaatttgtttaccgcgctggtaagcttattgtcgacacgacaagtgtcatagctaaacttttccagccattttgtgattttatatcacctttccttcggaaagttgctggttttgcaatttacactgttggtaatcgcatgcttatgtttaccagcactggcaccttttttctcacaaaggcaactactaagatactcaataaggcaaagtacatcttcgatgttgagcctgagtatccagtagctataacaacatctaaagttgtagtacatgaagcactccagcaaatcgacactaatcctgctagagctctagaggctgttgatgtcgttgttggtaacactgtactgcaaatggctactgatggcactgcgttctacccatcagatggtacgcatgcctctttaccaggattcaaagcaggttcggatgagcttctcataaacttcaactgcgacctctttgatgatgagactaatgctcaaatcaacgaaacactcgctgcatatgagcttaaccaactagtagctccaggtgattctacaccgcgtcaaattgcgacgttggttgtcgatacacttgtggatgctataacggaccactttccggagaaaaccattgatctacctgaagactatcaagtcttttctgaccatgatgacctcctacttgcacaataccacatccctgatcacctgagcctgtatattcaagctatggagggtgaggatgatagtggtgatgaaatatgtattgaggacggtgattacgactttcctcaagccgacgaaaacacagaaggagtaattccccaacagtgggaacttcctgatgttgataaatttttactcaagatccaggaacggaagaccagcagcgacgaagtacttagcgttgacgtctattctaaaccagatgaggttggggttgacgacagcgcgtcggaaaagaagccaaatggggacccagtaccggatcctgatgttcatccaacactagagagtgtggatgttgaacaaccaactgaaacagcaaatcaggctgttgaagacaaaccttctgataccacttttgtggttgatgaggaacaattacaagaatcaacatcagaacctgagctccgttcctatgaagaagattttgattctgatgatgaaattattatccctatagtaccagtaacacctgctgatttaaaaccacagactattactataaaggagtactttaagtctgaaaaacttgagactattaacgaaggatctacagagtcagttgcacagtctgacgattcgttcgacgaatcatttgctgatgctgagtctgatgatccacaagaccctgctgtatatgatgatacaacaattataacagacagtactgatgtaggcgatgagcctgagacaactctagctaccatcgttaacacaccactgacactcgataataacttgccacctgaagccattaaacaatccagcccgactaaggttgagttagttgttggcgaattggcaagtattaaatttgacaattctgtcttagtcaaccctgctaatgcgcaattaacaaatggcggtggagctgcccgtgcaattgcaaaattagctggtccaaaataccaagagtactgtaatagtgtggctcctatttcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacccatactaggtgctggtatctttggatgtaacccagtccactctctggatgcgttcaggaaagcctgtccaagtgacataggtcgtgtcacccttgtcactatgaacaaaaaccatttgcaggtgtgggatgctctcaacaggatcattgtacgtaccactactgattatgatcaagtcaccaccaaggcccttacaccccagggagtgttagaagccaatctctttgatggtgaggactttgttcaagaaccaaaacctggtcaaatctaccttgaggttactgaagaagttcagaaccaagccaaggaacttgaccttaatcttcagcaatactgcgtctacctgaagacttgccaccataaatgggttgtgagtcgtacgaatgggttgatgcatctaaaacaaaaagataacaattgttttgttagtgcaggtgtaaacctgtttcaaaacactgcttatcaacttagacctgctattgatgctctctatagggagtatctcaatggtaatccaaaccgatttgttgcttggatttatgcatccacaaaccatcgtgttggtgagatgggctgtccacagcaagttatttctttgctcgttagtaactctgacgcagcattctcagcaactacagcctgttgcaacacctactttaatcacacaggtgttatttcagtagcttgcgaatatgacccaatacaaccaaaggtctactgcatgaagtgtgacgtgtggactccctttacaccccagagtggaaaaggtgcagttgcaattggcacttctgcagatgaacctaccggtcctgccattaaatttgccgcagctcactgctggtacactaatggtaagaaaacagttaatggctatgacactaaagctaatgttgtagctacctatcataggtttgacgtgcctaagcctcaacttgtcgaggacgtggttgcgctgcctactaaaaatgactttgaggttctcaatgttgaagaactgccgcaggatagtgtgctccatttggacccacctcctgtacaggctttacaacctaaggctaaccaacacgttgagactctagaaaacccagattatctggacattttggatctttggattcgtaaacccaaattcatccttgtaaagtcatggagtgttttgggtagagcactatgtaaggcaggtagagttgtctttgtcagtgcttctcttttgacccgtttctacaattaccttgtagagattggtgctcttgactcaacaataaggttgtcaatcgatcttacctgtaaatttgttagaacggttctcccatcgtctaacactgtacgcaaaacttgtcttggtctgtattattcagcccagacaatttttgtttctttagcaccattccttatgttaccagctgtagctagtctgcttaattcaggctatacaattggcacatatttgtatgcaaaaactggctggccttgtaattacaatgccacgcaacactttgattataattcttactgtgcaggtgacttggtttgtcaagcttgttttgacggtcaagactccctacatttgtatccgcatttacgtgttaatcagcagccccttcaggccactgactacactgtttatgcgctttcactaatactactattagctaacatgactcttgtcatgggcacgctaatagttactttctttgtgaacttctatggtgtgcaaataccattttatggtacacttttgatagattatcagtccgcgctggtgatgactttctcagtgtactatttttataaggtaatgaagtttttccgccatctcacatatggatgtaaaattccaacgtgtgtggtatgtgctaaacttcgtaccccacctactataacagttgagactgtcgttcagggcaggaaatacccatctgttattgaaacaaatggcgggtttacaatttgtaaagagcacaacttctattgcaaggactgctcactacaaacacccggcactttcatcccgacagaagctattgagtcgctctcacgagctaccaggcttagtgtcaaaccaacagcaccagcattcttactagctagagatgttgagtgccaaactgatgttgtcgttgctcgcgcaatgcataaccaaaatgcgcatgtgtgcatttcaaaatactctgatattcgtaccgttgaccaactacttaaacctacaccactgttttcatacacccccgatgtcatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagatcacacccacaggtgacatctttacagacattaagcaagcgaccaatggccaagctagtgactctgctattaatgcagctgttttggctgtccaacgtggtcttgattttacaattgacaaccctaacaacatattgccacattacgcctttgacttttcaacccttactgcagaagaccagtctaccattttggagagtggttgtgctaaaggcaatctcaaaggcactaatgtcggtgttgttctttcagctagccttgttacacgtcttagtcagcaggctacacgtgtgatcgctaatgctgcttcacgtaatggtgttacttgcgccgttactccatctacacttgttatgcgtgggaatattgcaacacagcccttgactcgcatcaaagctggtgcacctcccatgcgtcaaaaaatcttatgtgttatcctggcacttgctattgtgtactttgctgctatggcttttggctttttggcaagtcaaattacgcttaatacagtgcctacgattaaatctgatatccgcgcctctaccttctacgtcgttagagatggagtcctggatactgttcgttcaaatgacaagtgttttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaacccaacagcgtcagtctatggttagggatgcgttgtcacttaagacagcaaacctctttaacctaggcaagcgcgttgtagtaggatacactcaacatgaagttgttgtgggtacctcctattttaattctcctgcactttttaacgcaaagtgtaccttcttacaatatcaggacactagacaactctattgctatgatactgtttctactgaacataagctttactctgatgtgcttcctcacgttgagtataaggctattgacattaatggtgatcttgttcctttcaagataccagagcaaataatgttctatccacatattgtgcgctatactagcaattcctattgccgtatggggcattgttttaatactaaccctggtatttgcatttcatttacggatgaatttccgtatagtgtaaatgtcaaacccggtgtatactgtgctgataccgctttgcagttggtttcaaaccttgttttgggcactgtatctggtattcacatctttacatcaacagctgcattgcttggatccactattgtgatcatactatgcgtcgttgctgttctcgcagttcagcgattcttcaaggagtacacgacttttgttatgtacacttgtggtcttgcccttgtcaacattgtgggcattgcacttatgtacaagtgccttgtcttcgcgattttctattatgcaatctatctttactttgtccttactttcccctcctttaagaggaatgtggcattgttttacttcgctgtagtgatcgtgccgcacgtgagcaacatgcagttgcttgcgctcattgtgtgtagcattatctactttctctacacttatgttcatactgtagctaagacagctgggaaattttcttccttcttagacgcagctaaagctacttttgtcattgacaatgataagtacgtgttgcttaaagaccttgctggtgctgaatttgaccagtatctggcttcttacaacaagtacaaatacttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccctcaggtgtagttgagcgatgcatggtctcagttgtctacaatgggtctgcattgaatggcatctggcttaagaatgtcgtctactgcccacgccatgtaattggaaaattccgtggtgaccagtggactcacatggtctcaattgctgattgccgcgactttatagtcaagtgtccaacacagggtattcagctaaatgtccaatcagttaagatggtaggagctctcctccagttaactgttcataccaacaacacagccactccagactataagtttgaaaggcttcaaccagggtcatcgatgacaattgcttgtgcctatgatggcattgtacggcatgtctatcacgtggtccttcaacttaataatcttatttatgcaagcttccttaatggagcttgtggtagtgtgggttacactcttaggggtaaaacactctacttacattacatgcaccacattgagtttaataacaaaactcatagtggtacagatcttgaaggtaacttctatggtccctatgtggatgaggaagttattcagcagcaaacagcattccagtattacactgataatgttgttgctcaattatatgcacacttactgactgttgatgccagaccaaaatggctgacacaatctcagataagtatcgaggattttaactcatgggctgctaacaattcctttgctaacttcccatgtgaacaaactaatatgtcctacattatgggactctcgcaaacaacgcgagttccggtagaacgtgttctcaataccattatacagctaaccaccaatagagatggtgcttgtattatggggtcttatgatttcgagtgtgattggacaccagagatggtgtacaatcaggctccaatctcactgcagtcaggagtagttaagaaaacttgtacgtggttcttccacttcttgtttatggctattaccatgctactcgctgccatgcatgtcttccctgtacacttgtactcaatagtactgccatgctttactgtcgtggcattcctgttgactttaaccattaaacacactgtagtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctaatctatgctggacttgcaatcaactatacgttgaaaacattccagtatagagcaacttcattcttatctttttgcatgcagtggtttcaatatggttatgttgcacacattgtgtacaaactgattaataaaccctggacagaatcactactcttcacagcctccacaatgctaaccagccatcctttgttggctgctcttagctggtggctagctggtcgtgtaactctgcccattatcatgcctgacttagctattcgcgttttggcgtataacgtcattggctatgtcatgtgtgtccgatttggccttatgtggcttgcaaatcggttcacaactgtacctatgggcacatatcagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttctcgaaaaggctggtgtcacaaacaagcacgctgtttgcaaaaagattgtgaaactccacaatgatacccttaaagccaccacttatgaggaggttgaggtagcacttgtgaaacttctttctcacataattgagttcttgccaactgatcaggtagatgcttacctagctgatgcggccaatgctcaacatgttaatacctattttgacaacttgcttgagaacaaagctgttgttcaggctgttgccgatatcaacattaatctggattcttatagaatttataaggaggcagatgctatttacaaacgatctgttgagatgaacgaatctctacaggagcaaaagaaaaagcttaaagctgttaacattgcaaaggcggaatgggagcgtgaggctgcttctcagcgtaagctcgaaaagcttgctgatgctgctatgaagtctatgtatcttgcagaacgtgctgaggatcgtcgcattaaactaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagatggcaacacacttatacataagggagttcgttacactattgtgaagaaactctccttagataatgcacctattgaaggcgtaccagaagaattccctgtggtcgttgagactgttagggagggtgtgccccagttgcaaaacaatgagctatgtttgcgcaatgttttcactgctcagaacacagctcaggacttcaatggcaatgaatccactgtaaaatctttttatgttactagaactggtaagaagattttggttgccattacatcaactaaagacaatcttaagactgtgacctgccttactgagaccggtaagacagtccttaatttggaccctcctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaaaacagcctaccttaagcatcttgctgatggtgggtctcctatacagggttgtattcagatgattgctactatgggtcctggatttgcagttactactaaaccacaacctaatgagcaccagtattcttatggtggtgcttcaatctgtctttattgccgtgctcatataccacatcctggtgttgatggacggtgcccctacaaaggccgctttgttcacattgacaaagataaggaacctgtttccttcgccttgactcatgagccatgcagttcttgtcagcggtgggttaattatgactgcacctgcggatctagtctgcagaattcggcttatttaaacgagtaacgggttctagtgacgcccggctagaacccctgcagcctgggactcaaccagatgctgtaaaaagggccttccatgtgcataatgatactacctctggtatattcttaagcacaaaatctaactgcgctcggtttaaaaccacacgcagtgccctgcctttacctaacaagggagaggttgaattgtactttgttactaagcagtgtgcagctaaagttttcgaaattgaggaggaatgctacaacgctattagtacagagctttatactactgatgatacatttggtgtccttgccaaaactgagttcttcaagtttgacaagatacctaatgtcaatcgccagtatttgactaaatatacactcctggacttggcttatgccttacgtcatttgtcaacatctaaggatgttattcaagaaatcttgatcaccatgtgcggcacccctgaagattggtttggggaaaattggtttgatccaattgaaaacccatccttttacaaggagttccataaacttggagatattcttaaccgctgtgttcttaatgccaataagtttgctagtgcctgtatagacgctggtcttgttggcatattaacgcccgacaatcaagacctcctgggtcagatttatgactttggagattttattattacacaaccaggtaatggatgtgtggatctagcatcctattattcttatttaatgcccattatgtccatgactcacatgttaaagtgtgagtgtatggatagtgatggcaacccacttgagtatgatggatttcagtatgacttcactgatttcaagcttggcttgttcgagaagtattttaagtactgggaccgtccttaccatcctaacactgttgaatgtccagatgaccgctgtgtattgcactgtgcgaacttcaacgttttgtttgctatgtgtatacctaatacggcatttggcaatctttgttcaagagccactgttgatggccaccttgtggttcaaacagtgggtgtacacttgaaagaacttggtatagtccttaaccaggacgttaccacgcacatggcaaatattaatctaaacactttattgcgattggtaggtgatcccaccaccattgcaagtgtctcagacaagtgtgtagatttaagaactccttgtcagaccttggctactatgtctagcgggatcgctaaacagtcagtcaagccggggcattttaatcaacatttctacaagcatttgcttgatagtaacctattagaccaacttggaatagacatgcgccacttctactatatgcaagatggtgaagcggctattacagactacagctactacaggtataatacacccacgatggtagatattaagatgttcttattttgccttgaggtggcagataagtatcttgagccctacgaaggtggatgtattaatgcacagtcagttgtggtttctaatttggacaagtcagcgggctacccctttaataagctaggtaaggctcgtaactattacgacatgactcatgccgagcaaaatcaactgtttgagtatacaaaacgcaatgttttacctacactcactcagatgaaccttaagtatgcaatttcagccaaggatcgtgctcgcactgttgcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaataatcccattttagtgggttgggattaccctaagtgtgatcgttctatgccaaacatgctgcgcattgccgcttcgtgcttgctagcacgaaaacacacctgctgtaaccaaagccagcgattctatcgtttggctaatgaatgttgccaagtactatcagaagttgtagtctctggtaacaacctctatgtaaaaccaggtggtactagcagtggtgatgcaaccacagcttacgccaactcggtctttaacatcttacaggtggtttctgctaatgtagccacctttttatcaacttccaccacgacacatcttaataaagacatagcggacttgcatcgtagtctttatgaagatatttatcgtggtgactctaatgatatcaccgtcatcaatagattctaccagcatctccaaagttactttggacttatgatattgtctgatgatggtgtcgcatgtatagactcagccgttgcaaaggctggagctgttgctgaccttgatggtttccgagacattttgttttaccaaaacaatgtttacatggcagattcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccccgttcagaaccttgaacgttacatctcacttgcaattgatgcatatcctctcaccaaggttgaccctattaagggtaaagtcttctacttgttactagattacatacgtgttcttgctcaggagttacaggatggtatccttgatgccttccaatcactcactgacatgtcgtatgtaaataactttatgaatgaggccttttatgctcagatgtatgagcaaagtcctacactacaagctagcggcgtttgtgtggtgtgtaattcacccactatactgcgctgtggtgattgcattcgtcgaccactactttgttgcgtctgtgcttaccagcatgttacgcagactacacataaacgtatcattgctatcaacaactacatctgtagtgttgagaattgcaatgaggacaatgttgaaaaacttttcatttctggcactgcgatttattgtgagaatcacaaacctacgctgtgcatacccattgtagctaatggttctgtttttggtatctatcgccacactgcccgtggtagtgacgacatagacctctttaacgagcttgctacatccaactatgatactattgaaccttatcagaaggccaatcgtgcacctttatcacttatgctcttcgctgctgagaccattaaggcactcgaggagtctatcaagaagtcatatgctaccgcaactgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaacttcaaacgggtgatgttctagtcttaatggcacatgttgtcacaccgctctcagcacccccagtgctaacgcagacaacatatgtcagaaaatcacttttacctgactctgttggtgcgtcttattatgtgcaacattttaagtcatataatgagatagctatgcagagggttacaacagtattaggcccaccaggcacaggtaagtcaacctttgctattggtttggctaagtattttcctagtgcacgtatttgctacactgcgtcttcgcatgcagcaatcgatgcactctgtgagaaagctttcaagacaatacctgtaggtcaatgcagtcgtatcgtacccacacgtacaactgttgagtgctttcaggagtttgtcgtaaataacacaactgcacagtatatcttctcgactatcaatgccttacctgacattaagtgtgacattgtggttgtagatgaggtttctatgttgaccaattatgagctctcctctgtgaatgctcgtttggtttacaatcacattgtgtatgttggtgatccttatcagttaccttcacctagaactatgcttacgtctggccagctttcgccggctgactataacgtagttactgatataatggtacatgcaggagcggatgttatgctcgacatgtgctacagatgcccacgtgaaatcgttgagacagtgtctaaacttgtctacgataataaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcaaaccgttgactcttctcaaggttctgagtatgattatgttatcttttgcgtgaccactgattcagcacacgcacttaacatggctcgtttgaacgttgcccttacacgtgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgttgaagcagcacacgccataaaacctaacactggaactaacctgccattgcaaataggttttagcaccggaaagaatttttcagttactccagagggaatttgggtaaacgagcacggatcttgcactgagcccgtccctgccaaaatacctcctggagaacaatttcgtcaccttaagaaggacatgcgccatgcgcgtccttggaaggttgttcgacgtgagattgctactcatattgctgaggtagctccccacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagtacatcattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgcttagctatccatgaactgttcagtactgttgactggaaccttgaatttccagtaactgctgagcaatcacaacttaacaaggcctgtcgcttagtacaggcaaactatttaaatatactactcactacaaccaaggccatggtggttcatgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcactcctgagatgcatacttatgctacacataaactcaacttggctccactcatctactactctaccacagattgtagtagtgaacagcctattgttgttacctacagagattgtgtcacccggtgcaatactggaaaaactctctgtccaaatcatgctcttgaataccaagagtttattaatgcatacaatctcatggctcgccatggatttaatgtttacataccacgcaatgtcaacgtctacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcttttgaacattacactaacaggcatacccgttcactgccaactacacagctgttatctggtttaggcgtaaccgccaccagaaatttcacggtgtggtttgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacatttgctactatttgtacacagggtagaaatgttgagcagtttatacctaaaacacctatggaaagagacttccttgagatgtctcaacagtccttcattcaacaataccaattgcaggatctgggtgttgaacacattatctatggtgatgattccagtccagtcattggcggaactcacacccttatctcactagttaaaaacaagtttgaacatcagcttgtcaaccatgtttacaacccagtccagaactgtgttgttacctcacctaacgcaagctccaagaacgtttgcactgttcttgatattcttcttgatgattacattgacatcataagacaagcacatgcctgttacacaagtaaatccaaagtattcactgtgtcaattgataaccaacaaattagattcatgctttggcatgatgagcaagtcaagacttgctatccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactatatagttaaaaaggataggttggcagtaccacacaatatgactgtattacacctcggagctgcgtctgcactaggtacagcaccaggttcttcagtcataaaacaaatgtttcctgaaggaactgttcttattgacctagatataagagagttcacttcagatgctaaccaaataatagttacagactacagaacttatatgccaccacaccacgtagacgtcatattctctgacctctactgttgtgatgacatacacttctttgataacctaataaggatagttaaggagaggcttgccctcggtggttctatctttgttaagataactgaacattcattctcatccgaactttactcactcgcgggttggtttgatgattatcaactattttgtacagcagtcaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcggacaacccggctacggcctgtaagctaaaagcaacccctattatttcggctcgtgagttagagaagaagcctattcttcgctatcttgttgcatcaggacgccttcttgtgaggccaccagaatgcagagagctctattgattatgaccttactttgtctcgctcgagctaagtttgctgatgatctactcgatttgctcaccttcccgggtgcacatcgcttcctacacaaacctacgaggaatgacagcattctttactcgcgggccaataataattttgatgttggcgttcttcctggctaccccactaagaacgttaacctcttctcaccacttaccaactctactctgcctattaatggacttcatcggagttatcaaccacttatgctgaattgtcttactaaaataactaaccaaactctcagcatgtatctccaacctagtgagatacaaacttatagctgcggcggtgccatggttaaataccagacacatgatgcagttcgtatcattttagacctcattgccactgaccgcatttctgttgaagtcgttggccaagctggtgaaaattatgtgtttgtttgtagtgatcagtttaactacaccactgcattacacaactccactttcttctcacttaattctcagctttattgcttcactaataacacctatttaggtattcttccacctgatttaactgactttacggtctatcgtactggtcagttctatgctaatggttaccttttaggtactttacctattactgttaactatgttaggttgtatcggggtcaattgtcggccaacagcgcccactttgcccttgcaaaccttaccgatacactcataacacttaccaatactactatatcgcaaatcacctattgtgataagtcagtagttgattcaatagcatgccagcgctcttctcatcaagtagaggatgggttttactctgaccctaaatctgccgttagagctaggcaacgcacaattgttacactacctaagctccctgagcttgaagtagtgcagttaaatatttctgcacacatggattttggcgaagccagacttgatagtgtcaccatcaatggtaacacatcctattgtgtcactaagccttacttcaggcttgaaactaactttctgtgcagaggctgcactatgaatctgcgcactgatacttgtagttttgacctgtcagcagtaaacaatggcatgtcattttctcaattctgtctaagcactgaatctggtgcttgtgagatgaaaattattgttacctacgtatggaattacttgctaaggcagcgtttgtatgttacagctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctcccccacaggtgagctttatgcatttaaaaatataaccactggcaaaaccctccaggtcttaccgtgtgaaaccccttctcaactgattgtgataaacaacaccgttgtcggtgctatcacatccagtaactcaactgaaaataataggtttactactactatcgtcacacctactttcttttattccacaaatgccaccactctcaactgcactaagcctgttttgtcctatggacctatcagcgtgtgtagtgatggtgcaattgctggaacatccacattacagaatactcgaccatccatagtttcactatacgatggcgaaattgaaataccatctgcattttctctttctgtccagacagagtatttgcaagttcaagcagagcaagttatagttgattgtccccagtatgtatgcaatggcaatagccgttgtctacaattactggcacaatacacctcagcttgctctaatattgaagttgctctgcattcctcagcacagctggacagcagagagattataagtatgtttaaaacatcaacacaatccttgcagttggctaatattaccaacttcaaaggcgactacaattttagcagtatactaacctccagagttggtggtagatctgctattgaagaccttctttttaataaagttgttactagtggccttggcactgttgatcaggactacaaatcctgttctaggaacatggccatcgctgatttagtttgttcccagtattacaatggcatcatggttctacctggtgttgttgatgctgagaaaatggcaatgtatactggctctcttactggagctatggtatttgggggactgactgctgcagcggcaataccattcgccactgcagtacaagcccgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacactgtagctattgctattaaaaagattcaaacagttgttaaccagcagggtgaggcactatcacacctgactgcacagctgtcaaataatttccaagcaatttcgacttctattcaagacatttacaaccgtcttgaggaagtagaggctaaccagcaagttgaccgtctcatcaatggacggttggctgcacttaatgcatatgttactcagctactcaatcagatgtctcagattagacaatcccgattgctagctcagcaaaagattaatgagtgtgtcaaatctcagtcgcccagatacggtttctgtggaaatggcacacacatcttctcacttactcagactgcaccaaacggcatatttttcatgcatgcagtacttgtacccaacaaattcacacgtgtcaacgcttctgcgggtatttgtgtggataatacgagaggctactcattgcagcctcaacttatactctaccagtttaataactcctggagagttacacctagaaatatgtatgaacccagactgccccggcaagctgatttcatacaattaactgattgcagcgttacgttttataacactaccgctgctaatcttcccaatattattcctgacgtcatagatgttaatcaaacagtcagtgatattattgataatttacctacagcaacaccccctcagtgggatgttggtatctataacaacactattctcaacctcaccgttgagattaatgatctacaagagcggtctaaaaacctctcacagattgcagatcgtttacaaaactatatagacaatcttaacaatactctagttgaccttgaatggctcaacagagtggaaacttaccttaaatggccgtggtatatatggcttgccatagccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcatttaagtttaaggaatggtagtcgacgactgggccgttaccatccctggacaatatattattgctatactagttgtcatctgcattggtgtggcactactttttattaacacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgatgcagaagagtggcaaattattgttttcattgcgatcatatgggcgcttggcgtcatcctccaaggaggctatgctacgcgtaatcgtgtgatctacgttattaaacttattctgctttggctgctccaacccttcaccctagtggtgactatttggaccgcagttgacagatcatctaagaaggacgcagttttcattgtgtccataatttttgccgtactgaccttcatatcctgggccaagtactggtatgactcaattcgtttactaatgaaaaccagatctgcatgggcactctcacctgagagtagactccttgcagggattatggatccaatgggtacatggaggtgcattcccatcgaccacatggctccgattctcacaccagtcgttaagcatggcaagctcaagctacatgggcaagagctggccaatggcatatcagttagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgcaaatccaattgcatttagcatactacctcggaaaattcttatcaatggcgagcctttactgcttgaatatggtagcatatatggtaaagactttatcattcgaccatcactccaagtcattcttgaagatgaattaaattaaagttttgacaccaatctatcatggctgcaccagtagttcctactactgacgcgtcgtggtttcaggtgctcaaagctcaaaataaaaaggctactcaccctcagtttcgtggcaatggagttccgcttaactccgccatcaaacccgctgaaaaccatggctactggctgcgttacaccagacaaaagccaggtggcactccgattcctccatcctatgccttttattatactggcacaggtcccagaggaaatcttaagtatggtgaactccctcctaatgatacccctgcaaccactcgtgttacttgggttaaaggttcgggagctgacacttctattaagcctcatgttgccaaacgcaaccccaacaatcctaaacatcagctgctacctctccgattcccaactggagatggtccagctcaaggtttcagagttgaccccttcaacgctagaggaagacctcaggagcgtggaagtggcccaagatctcaatctgttaaccccagaggcacaggcaatcagcccaggaaacgcgaccaatctgcacctgctgcggtacgtcgtaaaacccaacatcaagctcctaagcggactttacccaagggtaaaaccatttctcaggtatttggcaaccggtctcgtactggcgccaatgtcggctctgcagacactgagaagacgggtatggctgatcctcgcatcatggctctagccagacatgtgcctggtgttcaggaaatgctcttcgctggccaccttgagagcaactttcaggcgggggcaattaccctgaccttctcttactcaatgacagtcaaggagggttctcctgactatgagagacttaaggatgcgctcaacacggtcgttaaccagacctatgagccacccactaaaccaactaaggacaagaagcctgataaacaagaccagtctgctaaacctaaacagcagaagaaacctaaaaaggtaactctgccagcagacaaacaggactgggagtgggatgatgcttttgagataaagcaggaatcagcagcgtagacatcaatctatgtctctctacacacacccaaccacacttaaacatctctttgattccagagagtcatattgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggtcaaaggactgtactacttttgtaggtgtagcagtcgcccagtgggaaagcgccaactaggttacaattgtggtggggacaaattaggggaaattaaattggcttataggggggatggagca

SEQ ID NO: 62 - DNA, 25405 bp, Porcine Deltacoronavirus
acatggggactaaagataaaaattatagcactagtctataattttatctccctagcttcgctagttctctaccgacaccaatccaggtgcgtttgccaccaagttggctacccttaggggcgcttttgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttagtcacaccggtctgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcattcacgttgcagctgctgaagagggtcaccctaaggttactacttaccttggcaactataacctctacgccaccaaggctccgcctggcgtgcaggttcttagtgctaaaacctctcttactgattttgagaatgtctttggagctcaacccaccttgcgatcaattcgtaatctggtgtgtgaggctcgctcagctgaatggacaacttccaagaatgcttttgcactcaaagccactcaacttgactactctgatgccgttttgagggctatgattcgtttctgccctccaaaggtgtccacactcgctgcctttgctctttttggccgattggttaaaattgaggacaaggaacttgctgagttagcttgtgatactgcccttgagttggcatacactgctaaaattggtacatctcttgctgacacgagatctgtctcacttattcataaggacgcctatctaactctcagtaacgaggttgttggcgtaacttttactgccgcacttatggcaaaggctaccactgttaatggagcaatgcaatactcaaacttttacctctaccctcgcgccactatcaaggtgaccgatggtaaggctgaagcaattgcaactaagcctctgcctgctgccactaaaggcaagccaatcacagaggatgtcaacctcctccctgactatcagcagctgcttgttgatcaagtgactggcactgaggttaaggttggagccttaacttatgttaagaccactgacctaccacccctttactttcccaaagttaaaggcggtgttgttggtattgcacttaagcagcagggcactgcggctaagaagctcaatgtagtcttccatgctcaacctgatgatgttctgctagctttcatacaacttcagcaattcttgaaccgtacttcggattcaagtgttgaaattactgattgccagagttatgaagtctctccaactgtgacggtaaaaattggcccgtctaaacctggagatgtcatcgtggctactgatgaggaataccttaaatgctttgaaacccccgaggtaggtaggctctataaggttttccaaactcaatcttgggctatcattgagcgttccttctccaggatccgcgtgtccaaagctttatcagcatttataagttttctgcaaaaccttgcagataactttactgcactaagtggtgttgtcactgcactcattcgtgaactccaggatctcaccctggatgtggcgacacgtatcactaacatacaatttgtttaccgcgctggtaagcttattgtcgacacgacaagtgtcatagctaaacttttccagccattttgtgattttatatcacctttccttcggaaagttgctggttttgcaatttacactgttggtaatcgcatgcttatgtttaccagcactggcaccttttttctcacaaaggcaactactaagatactcaataaggcaaagtacatcttcgatgttgagcctgagtatccagtagctataacaacatctaaagttgtagtacatgaagcactccagcaaatcgacactaatcctgctagagctctagaggctgttgatgtcgttgttggtaacactgtactgcaaatggctactgatggcactgcgttctacccatcagatggtacgcatgcctctttaccaggattcaaagcaggttcggatgagcttctcataaacttcaactgcgacctctttgatgatgagactaatgctcaaatcaacgaaacactcgctgcatatgagcttaaccaactagtagctccaggtgattctacaccgcgtcaaattgcgacgttggttgtcgatacacttgtggatgctataacggaccactttccggagaaaaccattgatctacctgaagactatcaagtcttttctgaccatgatgacctcctacttgcacaataccacatccctgatcacctgagcctgtatattcaagctatggagggtgaggatgatagtggtgatgaaatatgtattgaggacggtgattacgactttcctcaagccgacgaaaacacagaaggagtaattccccaacagtgggaacttcctgatgttgataaatttttactcaagatccaggaacggaagaccagcagcgacgaagtacttagcgttgacgtctattctaaaccagatgaggttggggttgacgacagcgcgtcggaaaagaagccaaatggggacccagtaccggatcctgatgttcatccaacactagagagtgtggatgttgaacaaccaactgaaacagcaaatcaggctgttgaagacaaaccttctgataccacttttgtggttgatgaggaacaattacaagaatcaacatcagaacctgagctccgttcctatgaagaagattttgattctgatgatgaaattattatccctatagtaccagtaacacctgctgatttaaaaccacagactattactataaaggagtactttaagtctgaaaaacttgagactattaacgaaggatctacagagtcagttgcacagtctgacgattcgttcgacgaatcatttgctgatgctgagtctgatgatccacaagaccctgctgtatatgatgatacaacaattataacagacagtactgatgtaggcgatgagcctgagacaactctagctaccatcgttaacacaccactgacactcgataataacttgccacctgaagccattaaacaatccagcccgactaaggttgagttagttgttggcgaattggcaagtattaaatttgacaattctgtcttagtcaaccctgctaatgcgcaattaacaaatggcggtggagctgcccgtgcaattgcaaaattagctggtccaaaataccaagagtactgtaatagtgtggctcctatttcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacccatactaggtgctggtatctttggatgtaacccagtccactctctggatgcgttcaggaaagcctgtccaagtgacataggtcgtgtcacccttgtcactatgaacaaaaaccatttgcaggtgtgggatgctctcaacaggatcattgtacgtaccactactgattatgatcaagtcaccaccaaggcccttacaccccagggagtgttagaagccaatctctttgatggtgaggactttgttcaagaaccaaaacctggtcaaatctaccttgaggttactgaagaagttcagaaccaagccaaggaacttgaccttaatcttcagcaatactgcgtctacctgaagacttgccaccataaatgggttgtgagtcgtacgaatgggttgatgcatctaaaacaaaaagataacaattgttttgttagtgcaggtgtaaacctgtttcaaaacactgcttatcaacttagacctgctattgatgctctctatagggagtatctcaatggtaatccaaaccgatttgttgcttggatttatgcatccacaaaccatcgtgttggtgagatgggctgtccacagcaagttatttctttgctcgttagtaactctgacgcagcattctcagcaactacagcctgttgcaacacctactttaatcacacaggtgttatttcagtagcttgcgaatatgacccaatacaaccaaaggtctactgcatgaagtgtgacgtgtggactccctttacaccccagagtggaaaaggtgcagttgcaattggcacttctgcagatgaacctaccggtcctgccattaaatttgccgcagctcactgctggtacactaatggtaagaaaacagttaatggctatgacactaaagctaatgttgtagctacctatcataggtttgacgtgcctaagcctcaacttgtcgaggacgtggttgcgctgcctactaaaaatgactttgaggttctcaatgttgaagaactgccgcaggatagtgtgctccatttggacccacctcctgtacaggctttacaacctaaggctaaccaacacgttgagactctagaaaacccagattatctggacattttggatctttggattcgtaaacccaaattcatccttgtaaagtcatggagtgttttgggtagagcactatgtaaggcaggtagagttgtctttgtcagtgcttctcttttgacccgtttctacaattaccttgtagagattggtgctcttgactcaacaataaggttgtcaatcgatcttacctgtaaatttgttagaacggttctcccatcgtctaacactgtacgcaaaacttgtcttggtctgtattattcagcccagacaatttttgtttctttagcaccattccttatgttaccagctgtagctagtctgcttaattcaggctatacaattggcacatatttgtatgcaaaaactggctggccttgtaattacaatgccacgcaacactttgattataattcttactgtgcaggtgacttggtttgtcaagcttgttttgacggtcaagactccctacatttgtatccgcatttacgtgttaatcagcagccccttcaggccactgactacactgtttatgcgctttcactaatactactattagctaacatgactcttgtcatgggcacgctaatagttactttctttgtgaacttctatggtgtgcaaataccattttatggtacacttttgatagattatcagtccgcgctggtgatgactttctcagtgtactatttttataaggtaatgaagtttttccgccatctcacatatggatgtaaaattccaacgtgtgtggtatgtgctaaacttcgtaccccacctactataacagttgagactgtcgttcagggcaggaaatacccatctgttattgaaacaaatggcgggtttacaatttgtaaagagcacaacttctattgcaaggactgctcactacaaacacccggcactttcatcccgacagaagctattgagtcgctctcacgagctaccaggcttagtgtcaaaccaacagcaccagcattcttactagctagagatgttgagtgccaaactgatgttgtcgttgctcgcgcaatgcataaccaaaatgcgcatgtgtgcatttcaaaatactctgatattcgtaccgttgaccaactacttaaacctacaccactgttttcatacacccccgatgtcatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagatcacacccacaggtgacatctttacagacattaagcaagcgaccaatggccaagctagtgactctgctattaatgcagctgttttggctgtccaacgtggtcttgattttacaattgacaaccctaacaacatattgccacattacgcctttgacttttcaacccttactgcagaagaccagtctaccattttggagagtggttgtgctaaaggcaatctcaaaggcactaatgtcggtgttgttctttcagctagccttgttacacgtcttagtcagcaggctacacgtgtgatcgctaatgctgcttcacgtaatggtgttacttgcgccgttactccatctacacttgttatgcgtgggaatattgcaacacagcccttgactcgcatcaaagctggtgcacctcccatgcgtcaaaaaatcttatgtgttatcctggcacttgctattgtgtactttgctgctatggcttttggctttttggcaagtcaaattacgcttaatacagtgcctacgattaaatctgatatccgcgcctctaccttctacgtcgttagagatggagtcctggatactgttcgttcaaatgacaagtgttttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaacccaacagcgtcagtctatggttagggatgcgttgtcacttaagacagcaaacctctttaacctaggcaagcgcgttgtagtaggatacactcaacatgaagttgttgtgggtacctcctattttaattctcctgcactttttaacgcaaagtgtaccttcttacaatatcaggacactagacaactctattgctatgatactgtttctactgaacataagctttactctgatgtgcttcctcacgttgagtataaggctattgacattaatggtgatcttgttcctttcaagataccagagcaaataatgttctatccacatattgtgcgctatactagcaattcctattgccgtatggggcattgttttaatactaaccctggtatttgcatttcatttacggatgaatttccgtatagtgtaaatgtcaaacccggtgtatactgtgctgataccgctttgcagttggtttcaaaccttgttttgggcactgtatctggtattcacatctttacatcaacagctgcattgcttggatccactattgtgatcatactatgcgtcgttgctgttctcgcagttcagcgattcttcaaggagtacacgacttttgttatgtacacttgtggtcttgcccttgtcaacattgtgggcattgcacttatgtacaagtgccttgtcttcgcgattttctattatgcaatctatctttactttgtccttactttcccctcctttaagaggaatgtggcattgttttacttcgctgtagtgatcgtgccgcacgtgagcaacatgcagttgcttgcgctcattgtgtgtagcattatctactttctctacacttatgttcatactgtagctaagacagctgggaaattttcttccttcttagacgcagctaaagctacttttgtcattgacaatgataagtacgtgttgcttaaagaccttgctggtgctgaatttgaccagtatctggcttcttacaacaagtacaaatacttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccctcaggtgtagttgagcgatgcatggtctcagttgtctacaatgggtctgcattgaatggcatctggcttaagaatgtcgtctactgcccacgccatgtaattggaaaattccgtggtgaccagtggactcacatggtctcaattgctgattgccgcgactttatagtcaagtgtccaacacagggtattcagctaaatgtccaatcagttaagatggtaggagctctcctccagttaactgttcataccaacaacacagccactccagactataagtttgaaaggcttcaaccagggtcatcgatgacaattgcttgtgcctatgatggcattgtacggcatgtctatcacgtggtccttcaacttaataatcttatttatgcaagcttccttaatggagcttgtggtagtgtgggttacactcttaggggtaaaacactctacttacattacatgcaccacattgagtttaataacaaaactcatagtggtacagatcttgaaggtaacttctatggtccctatgtggatgaggaagttattcagcagcaaacagcattccagtattacactgataatgttgttgctcaattatatgcacacttactgactgttgatgccagaccaaaatggctgacacaatctcagataagtatcgaggattttaactcatgggctgctaacaattcctttgctaacttcccatgtgaacaaactaatatgtcctacattatgggactctcgcaaacaacgcgagttccggtagaacgtgttctcaataccattatacagctaaccaccaatagagatggtgcttgtattatggggtcttatgatttcgagtgtgattggacaccagagatggtgtacaatcaggctccaatctcactgcagtcaggagtagttaagaaaacttgtacgtggttcttccacttcttgtttatggctattaccatgctactcgctgccatgcatgtcttccctgtacacttgtactcaatagtactgccatgctttactgtcgtggcattcctgttgactttaaccattaaacacactgtagtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctaatctatgctggacttgcaatcaactatacgttgaaaacattccagtatagagcaacttcattcttatctttttgcatgcagtggtttcaatatggttatgttgcacacattgtgtacaaactgattaataaaccctggacagaatcactactcttcacagcctccacaatgctaaccagccatcctttgttggctgctcttagctggtggctagctggtcgtgtaactctgcccattatcatgcctgacttagctattcgcgttttggcgtataacgtcattggctatgtcatgtgtgtccgatttggccttatgtggcttgcaaatcggttcacaactgtacctatgggcacatatcagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttctcgaaaaggctggtgtcacaaacaagcacgctgtttgcaaaaagattgtgaaactccacaatgatacccttaaagccaccacttatgaggaggttgaggtagcacttgtgaaacttctttctcacataattgagttcttgccaactgatcaggtagatgcttacctagctgatgcggccaatgctcaacatgttaatacctattttgacaacttgcttgagaacaaagctgttgttcaggctgttgccgatatcaacattaatctggattcttatagaatttataaggaggcagatgctatttacaaacgatctgttgagatgaacgaatctctacaggagcaaaagaaaaagcttaaagctgttaacattgcaaaggcggaatgggagcgtgaggctgcttctcagcgtaagctcgaaaagcttgctgatgctgctatgaagtctatgtatcttgcagaacgtgctgaggatcgtcgcattaaactaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagatggcaacacacttatacataagggagttcgttacactattgtgaagaaactctccttagataatgcacctattgaaggcgtaccagaagaattccctgtggtcgttgagactgttagggagggtgtgccccagttgcaaaacaatgagctatgtttgcgcaatgttttcactgctcagaacacagctcaggacttcaatggcaatgaatccactgtaaaatctttttatgttactagaactggtaagaagattttggttgccattacatcaactaaagacaatcttaagactgtgacctgccttactgagaccggtaagacagtccttaatttggaccctcctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaaaacagcctaccttaagcatcttgctgatggtgggtctcctatacagggttgtattcagatgattgctactatgggtcctggatttgcagttactactaaaccacaacctaatgagcaccagtattcttatggtggtgcttcaatctgtctttattgccgtgctcatataccacatcctggtgttgatggacggtgcccctacaaaggccgctttgttcacattgacaaagataaggaacctgtttccttcgccttgactcatgagccatgcagttcttgtcagcggtgggttaattatgactgcacctgcggatctagtctgcagaattcggcttatttaaacgagtaacgggttctagtgacgcccggctagaacccctgcagcctgggactcaaccagatgctgtaaaaagggccttccatgtgcataatgatactacctctggtatattcttaagcacaaaatctaactgcgctcggtttaaaaccacacgcagtgccctgcctttacctaacaagggagaggttgaattgtactttgttactaagcagtgtgcagctaaagttttcgaaattgaggaggaatgctacaacgctattagtacagagttttatactactgatgatacatttggtgtccttgccaaaactgagttcttcaagtttgacaagatacctaatgtcaatcgccagtatttgactaaatatacactcctggacttggcttatgccttacgtcatttgtcaacatctaaggatgttattcaagaaatcttgatcaccatgtgcggcacccctgaagattggtttggggaaaattggtttgatccaattgaaaacccatccttttacaaggagttccataaacttggagatattcttaaccgctgtgttcttaatgccaataagtttgctagtgcctgtatagacgctggtcttgttggcatattaacgcccgacaatcaagacctcctgggtcagatttatgactttggagattttattattacacaaccaggtaatggatgtgtggatctagcatcctattattcttatttaatgcccattatgtccatgactcacatgttaaagtgtgagtgtatggatagtgatggcaacccacttgagtatgatggatttcagtatgacttcactgatttcaagcttggcttgttcgagaagtattttaagtactgggaccgtccttaccatcctaacactgttgaatgtccagatgaccgctgtgtattgcactgtgcgaacttcaacgttttgtttgctatgtgtatacctaatacggcatttggcaatctttgttcaagagccactgttgatggccaccttgtggttcaaacagtgggtgtacacttgaaagaacttggtatagtccttaaccaggacgttaccacgcacatggcaaatattaatctaaacactttattgcgattggtaggtgatcccaccaccattgcaagtgtctcagacaagtgtgtagatttaagaactccttgtcagaccttggctactatgtctagcgggatcgctaaacagtcagtcaagccggggcattttaatcaacatttctacaagcatttgcttgatagtaacctattagaccaacttggaatagacatgcgccacttctactatatgcaagatggtgaagcggctattacagactacagctactacaggtataatacacccacgatggtagatattaagatgttcttattttgccttgaggtggcagataagtatcttgagccctacgaaggtggatgtattaatgcacagtcagttgtggtttctaatttggacaagtcagcgggctacccctttaataagctaggtaaggctcgtaactattacgacatgactcatgccgagcaaaatcaactgtttgagtatacaaaacgcaatgttttacctacactcactcagatgaaccttaagtatgcaatttcagccaaggatcgtgctcgcactgttgcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaataatcccattttagtgggttgggattaccctaagtgtgatcgttctatgccaaacatgctgcgcattgccgcttcgtgcttgctagcacgaaaacacacctgctgtaaccaaagccagcgattctatcgtttggctaatgaatgttgccaagtactatcagaagttgtagtctctggtaacaacctctatgtaaaaccaggtggtactagcagtggtgatgcaaccacagcttacgccaactcggtctttaacatcttacaggtggtttctgctaatgtagccacctttttatcaacttccaccacgacacatcttaataaagacatagcggacttgcatcgtagtctttatgaagatatttatcgtggtgactctaatgatatcaccgtcatcaatagattctaccagcatctccaaagttactttggacttatgatattgtctgatgatggtgtcgcatgtatagactcagccgttgcaaaggctggagctgttgctgaccttgatggtttccgagacattttgttttaccaaaacaatgtttacatggcagattcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccccgttcagaaccttgaacgttacatctcacttgcaattgatgcatatcctctcaccaaggttgaccctattaagggtaaagtcttctacttgttactagattacatacgtgttcttgctcaggagttacaggatggtatccttgatgccttccaatcactcactgacatgtcgtatgtaaataactttatgaatgaggccttttatgctcagatgtatgagcaaagtcctacactacaagctagcggcgtttgtgtggtgtgtaattcacccactatactgcgctgtggtgattgcattcgtcgaccactactttgttgcgtctgtgcttaccagcatgttacgcagactacacataaacgtatcattgctatcaacaactacatctgtagtgttgagaattgcaatgaggacaatgttgaaaaacttttcatttctggcactgcgatttattgtgagaatcacaaacctacgctgtgcatacccattgtagctaatggttctgtttttggtatctatcgccacactgcccgtggtagtgacgacatagacctctttaacgagcttgctacatccaactatgatactattgaaccttatcagaaggccaatcgtgcacctttatcacttatgctcttcgctgctgagaccattaaggcactcgaggagtctatcaagaagtcatatgctaccgcaactgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaacttcaaacgggtgatgttctagtcttaatggcacatgttgtcacaccgctctcagcacccccagtgctaacgcagacaacatatgtcagaaaatcacttttacctgactctgttggtgcgtcttattatgtgcaacattttaagtcatataatgagatagctatgcagagggttacaacagtattaggcccaccaggcacaggtaagtcaacctttgctattggtttggctaagtattttcctagtgcacgtatttgctacactgcgtcttcgcatgcagcaatcgatgcactctgtgagaaagctttcaagacaatacctgtaggtcaatgcagtcgtatcgtacccacacgtacaactgttgagtgctttcaggagtttgtcgtaaataacacaactgcacagtatatcttctcgactatcaatgccttacctgacattaagtgtgacattgtggttgtagatgaggtttctatgttgaccaattatgagctctcctctgtgaatgctcgtttggtttacaatcacattgtgtatgttggtgatccttatcagttaccttcacctagaactatgcttacgtctggccagctttcgccggctgactataacgtagttactgatataatggtacatgcaggagcggatgttatgctcgacatgtgctacagatgcccacgtgaaatcgttgagacagtgtctaaacttgtctacgataataaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcaaaccgttgactcttctcaaggttctgagtatgattatgttatcttttgcgtgaccactgattcagcacacgcacttaacatggctcgtttgaacgttgcccttacacgtgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgttgaagcagcacacgccataaaacctaacactggaactaacctgccattgcaaataggttttagcaccggaaagaatttttcagttactccagagggaatttgggtaaacgagcacggatcttgcactgagcccgtccctgccaaaatacctcctggtgaacaatttcgtcaccttaagaaggacatgcgccatgcgcgtccttggaaggttgttcgacgtgagattgctactcatattgctgaggtagctccccacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagtacatcattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgcttagctatccatgaactgttcagtactgttgactggaaccttgaatttccagtaactgctgagcaatcacaacttaacaaggcctgtcgcttagtacaggcaaactatttaaatatactactcactacaaccaaggccatggtggttcatgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcactcctgagatgcatacttatgctacacataaactcaacttggctccactcatctactactctaccacagattgtagtagtgaacagcctattgttgttacctacagagattgtgtcacccggtgcaatactggaaaaactctctgtccaaatcatgctcttgaataccaagagtttattaatgcatacaatctcatggctcgccatggatttaatgtttacataccacgcaatgtcaacgtctacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcttttgaacattacactaacaggcatacccgttcactgccaactacacagctgttatctggtttaggcgtaaccgccaccagaaatttcacggtgtggtttgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacatttgctactatttgtacacagggtagaaatgttgagcagtttatacctaaaacacctatggaaagagacttccttgagatgtctcaacagtccttcattcaacaataccaattgcaggacctgggtgttgaacacattatctatggtgatgattccagtccagtcattggcggaactcacacccttatctcactagttaaaaacaagtttgaacatcagcttgtcaaccatgtttacaacccagtccagaactgtgttgttacctcacctaacgcaagctccaagaacgtttgcactgttcttgatattcttattgatgattacattgacatcataagacaagcacatgcctgttacacaagtaaatccaaagtattcactgtgtcaattgataaccaacaaattagattcatgctttggcatgatgagcaagtcaagacttgctatccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactatatagttaaaaaggataggttggcagtaccacacaatatgactgtattacacctcggagctgcgtctgcactaggtacagcaccaggttcttcagtcataaaacaaatgtttcctgaaggaactgttcttattgacctagatataagagagttcacttcagatgctaaccaaataatagttacagactacagaacttatatgccaccacaccacgtagacgtcatattctctgacctctactgttgtgatgacatacacttctttgataacctaataaggatagttaaggagaggcttgccctcggtggttctatctttgttaagataactgaacattcattctcatccgaactttactcactcgcgggttggtttgatgattatcaactattttgtacagcagtcaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcggacaacccggctacggcctgtaagctaaaagcaacccctattatttcggctcgtgagttagagaagaagcctattcttcgctatcttgttgcatcaggacgccttcttgtgaggccaccagaatgcagagagctctattgattatgaccttactttgtctcgctcgagctaagtttgctgatgatctactcgatttgctcaccttcccgggtgcacatcgcttcctacacaaacctacgaggaatgacagcattctttactcgcgggccaataataattttgatgttggcgttcttcctggctaccccactaagaacgttaacctcttctcaccacttaccaactctactctgcctattaatggacttcatcggagttatcaaccacttatgctgaattgtcttactaaaataactaaccaaactctcagcatgtatctccaacctagtgagatacaaacttatagctgcggcggtgccatggttaaataccagacacatgatgcagttcgtatcattttagacctcattgccactgaccgcatttctgttgaagtcgttggccaagctggtgaaaattatgtgtttgtttgtagtgatcagtttaactacaccactgcattacacaactccactttcttctcacttaattctcagctttattgcttcactaataacacctatttaggtattcttccacctgatttaactgactttacggtctatcgtactggtcagttctatgctaatggttaccttttaggtactttacctattactgttaactatgttaggttgtatcggggtcaattgtcggccaacagcgcccactttgcccttgcaaaccttaccgatacactcataacacttaccaatactactatatcgcaaatcacctattgtgataagtcagtagttgattcaatagcatgccagcgctcttctcatcaagtagaggatgggttttactctgaccctaaatctgccgttagagctaggcaacgcacaattgttacactacctaagctccctgagcttgaagtagtgcagttaaatatttctgcacacatggattttggcgaagccagacttgatagtgtcaccatcaatggtaacacatcctattgtgtcactaagccttacttcaggcttgaaactaactttctgtgcagaggctgcactatgaatctgcgcactgatacttgtagttttgacctgtcagcagtaaacaatggcatgtcattttctcaattctgtctaagcactgaatctggtgcttgtgagatgaaaattattgttacctacgtatggaattacttgctaaggcagcgtttgtatgttacagctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctcccccacaggtgagctttatgcatttaaaaatataaccactggcaaaaccctccaggtcttaccgtgtgaaaccccttctcaactgattgtgataaacaacaccgttgtcggtgctatcacatccagtaactcaactgaaaataataggtttactactactatcgacacacctactttcttttattccacaaatgccaccactctcaactgcactaagcctgttttgtcctatggacctatcagcgtgtgtagtgatggtgcaattgctggaacatccacattacagaatactcgaccatccatagtttcactatacgatggcgaaattgaaataccatctgcattttctctttctgtccagacagagtatttgcaagttcaagcagagcaagttatagttgattgtccccagtatgtatgcaatggcaatagccgttgtctacaattactggcacaatacacctcagcttgctctaatattgaagttgctctgcattcctcagcacagctggacagcagagagattataagtatgtttaaaacatcaacacaatccttgcagttggctaatattaccaacttcaaaggcgactacaattttagcagtatactaacctccagagttggtggtagatctgctattgaagaccttctttttaataaagttgttactagtggccttggcactgttgatcaggactacaaatcctgttctaggaacatggccatcgctgatttagtttgttcccagtattacaatggcatcatggttctacctggtgttgttgatgctgagaaaatggcaatgtatactggctctcttactggagctatggtatttgggggactgactgctgcagcggcaataccattcgccactgcagtacaagcccgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacactgtagctattgctattaaaaagattcaaacagttgttaaccagcagggtgaggcactatcacacctgactgcacagctgtcaaataatttccaagcaatttcgacttctattcaagacatttacaaccgtcttgaggaagtagaggctaaccagcaagttgaccgtctcatcaatggacggttggctgcacttaatgcatatgttactcagctactcaatcagatgtctcagattagacaatcccgattgctagctcagcaaaagattaatgagtgtgtcaaatctcagtcgcccagatacggtttctgtggaaatggcacacacatcttctcacttactcagactgcaccaaacggcatatttttcatgcatgcagtacttgtacccaacaaattcacacgtgtcaacgcttctgcgggtatttgtgtggataatacgagaggctactcattgcagcctcaacttatactctaccagtttaataactcctggagagttacacctagaaatatgtatgaacccagactgccccggcaagctgatttcatacaattaactgattgcagcgttacgttttataacactaccgctgctaatcttcccaatattattcctgacgtcatagatgttaatcaaacagtcagtgatattattgataatttacctacagcaacaccccctcagtgggatgttggtatctataacaacactattctcaacctcaccgttgagattaatgatctacaagagcggtctaaaaacctctcacagattgcagatcgtttacaaaactatatagacaatcttaacaatactctagttgaccttgaatggctcaacagagtggaaacttaccttaaatggccgtggtatatatggcttgccatagccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcatttaagtttaaggaatggtagtcgacgactgggccgttaccatccctggacaatatattattgctatactagttgtcatctgcattggtgtggcactactttttattaacacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgatgcagaagagtggcaaattattgttttcattgcgatcatatgggcgcttggcgtcatcctccaaggaggctatgctacgcgtaatcgtgtgatctacgttattaaacttattctgctttggctgctccaacccttcaccctagtggtgactatttggaccgcagttgacagatcatctaagaaggacgcagttttcattgtgtccataatttttgccgtactgaccttcatatcctgggccaagtactggtatgactcaattcgtttactaatgaaaaccagatctgcatgggcactctcacctgagagtagactccttgcagggattatggatccaatgggtacatggaggtgcattcccatcgaccacatggctccgattctcacaccagtcgttaagcatggcaagctcaagctacatgggcaagagctggccaatggcatatcagttagaaatccgccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctgtataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgcaaatccaattgcatttagcatactacctcggaaaattcttatcaatggcgagcctttactgcttgaatatggtagcatatatggtaaagactttatcattcgaccatcactccaagtcattcttgaagatgaattaaattaaagttttgacaccaatctatcatggctgcaccagtagttcctactactgacgcgtcgtggtttcaggtgctcaaagctcaaaataaaaaggctactcaccctcagtttcgtggcaatggagttccgcttaactccgccatcaaacccgctgaaaaccatggctactggctgcgttacaccagacaaaagccaggtggcactccgattcctccatcctatgccttttattatactggcacaggtcccagaggaaatcttaagtatggtgaactccctcctaatgatacccctgcaaccactcgtgttacttgggttaaaggttcgggagctgacacttctattaagcctcatgttgccaaacgcaaccccaacaatcctaaacatcagctgctacctctccgattcccaactggagatggtccagctcaaggtttcagagttgaccccttcaacgctagaggaagacctcaggagcgtggaagtggcccaagatctcaatctgttaaccccagaggcacaggcaatcagcccaggaaacgcgaccaatctgcacctgctgcggtacgtcgtaaaacccaacatcaagctcctaagcggactttacccaagggtaaaaccatttctcaggtatttggcaaccggtctcgtactggcgccaatgtcggctctgcagacactgagaagacgggtatggctgatcctcgcatcatggctctagccagacatgtgcctggtgttcaggaaatgctcttcgctggccaccttgagagcaactttcaggcgggggcaattaccctgaccttctcttactcaatgacagtcaaggagggttctcctgactatgagagacttaaggatgcgctcaacacggtcgttaaccagacctatgagccacccactaaaccaactaaggacaagaagcctgataaacaagaccagtctgctaaacctaaacagcagaagaaacctaaaaaggtaactctgccagcagacaaacaggactgggagtgggatgatgcttttgagataaagcaggaatcagcagcgtagacatcaatctatgtctctctacacacacccaaccacacttaaacatctctttgattccagagagtcatattgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggtcaaaggactgtactacttttgtaggtgtagcagtcgcccagtgggaaagcgccaactaggttacaattgtggtggggacaaattaggggaaattaaattggcttataggggggatggagca

SEQ ID NO: 63 - DNA, 25403 bp, Porcine Deltacoronavirus
acatggggactaaagataaaaattatagcactagtctataattttatctccctagcttcgctagttctctaccgacaccaatccaggtgcgtttgccaccaagttggctacccttaggggcgcttttgcgcttgctcaccattagattacctggaaaccagccattcaggttggagtttccccaggctcttttgtgtgggcattagcggcttgtggtttttgcacaaaatctaagctacttaccgttcctctgaccatccaccacttctatagacagcactgattaccgtagggtttaagtcacaccggtttgcaccgcccgtcagcggacacattacccagcatagcactccttgcaccgagcctaggtaggataaaaccccctaccgggtgactcttaaggcgtttcctccacgggatagccactagtcactaggtgtaagtgatctgatctgggcgtattgtgttgcgcaagtgtgatacccataggagcgtggaatcctattctgcggctcagtgcctgatatagctgtgaaatggccaagaacaagtccaagcgcgacgctatcgcgttgcctgaaaatgtaccaccacctctgcaacttttcattcacgttgcagctgctgaagagggtcaccctaaggttactacttaccttggcaactataacctctacgccaccaaggctccgcctggcgtgcaggttcttagtgctaaaacctctcttactgattttgagaatgtctttggagctcaacccaccttgcgatcaattcgtaatctggtgtgtgaggctcgctcagctgaatggataacttccaagaatgcttttgcactcaaagccactcaacttgactactctgatgccgttttgagggctatgattcgtttctgccctccaaaggtgtccacactcgctgcctttgctctttttggccgattggttaaaattgaggacaaggaacttgctgagttagcttgtgatactgcccttgagttggcatacactgctaaaattggtacatctcttgctgacacgagatctgtctcacttattcataaggacgcctatctaactctcagtaacgaggttgttggcgtaacttttactgccgcacttatggcaaaggctaccactgttaatggagcaatgcaatactcaaacttttacctctaccctcgcgccactatcaaggtgaccgatggtaaggctgaagcaattgcaactaagcctctgcctgctgccactaaaggcaagccaatcacagaggatgtcaacctcctccctgactatcagcagctgcttgttgatcaagtgactggcactgaggttaaggttggagccttaacttatgttaagaccactgacctaccacccctttactttcccaaagttaaaggcggtgttgttggtattgcacttaagcagcagggcactgcggctaagaagctcaatgtagtcttccatgctcaacctgatgatgttctgctagctttcatacaacttcagcaattcttgaaccgtacttcggattcaagtgttgaaattactgattgccagagttatgaagtctctccaactgtgacggtaaaaattggcccgtctaaacctggagatgtcatcgtggctactgatgaggaataccttaaatgctttgaaacccccgaggtaggtaggctctataaggttttccaaactcaatcttgggctatcattgagcgttccttctccaggatccgcgtgtccaaagctttatcagcatttataagttttctgcaaaaccttgcagataactttactgcactaagtggtgttgtcactgcactcattcgtgaactccaggatctcaccctggatgtggcgacacgtatcactaacatacaatttgtttaccgcgctggtaagcttattgtcgacacgacaagtgtcatagctaaacttttccagccattttgtgattttatatcacctttccttcggaaagttgctggttttgcaatttacactgttggtaatcgcatgcttatgtttaccagcactggcaccttttttctcacaaaggcaactactaagatactcaataaggcaaagtacatcttcgatgttgagcctgagtatccagtagctataacaacatctaaagttgtagtacatgaagcactccagcaaatcgacactaatcctgctagagctctagaggctgttgatgtcgttgttggtaacactgtactgcaaatggctactgatggcactgcgttctacccatcagatggtacgcatgcctctttaccaggattcaaagcaggttcggatgagcttctcataaacttcaactgcgacctctttgatgatgagactaatgctcaaatcaacgaaacactcgctgcatatgagcttaaccaactagtagctccaggtgattctacaccgcgtcaaattgcgacgttggttgtcgatacacttgtggatgctataacggaccactttccggagaaaaccattgatctacctgaagactatcaagtcttttctgaccatgatgacctcctacttgcacaataccacatccctgatcacctgagcctgtatattcaagctatggagggtgaggatgatagtggtgatgaaatatgtattgaggacggtgattacgactttcctcaagccgacgaaaacacagaaggagtaattccccaacagtgggaacttcctgatgttgataaatttttactcaagatccaggaacggaagaccagcagcgacgaagtacttagcgttgacgtctattctaaaccagatgaggttggggttgacgacagcgcgtcggaaaagaagccaaatggggacccagtaccggatcctgatgttcatccaacactagagagtgtggatgttgaacaaccaactgaaacagcaaatcaggctgttgaagacaaaccttctgataccacttttgtggttgatgaggaacaattacaagaatcaacatcagaacctgagctccgttcctatgaagaagattttgattctgatgatgaaattattatccctatagtaccagtaacacctgctgatttaaaaccacagactattactataaaggagtactttaagtctgaaaaacttgagactattaacgaaggatctacagagtcagttgcacagtctgacgattcgttcgacgaatcatttgctgatgctgagtctgatgatccacaagaccctgctgtatatgatgatacaacaattataacagacagtactgatgtaggcgatgagcctgagacaactctagctaccatcgttaacacaccactgacactcgataataacttgccacctgaagccattaaacaatccagcccgactaaggttgagttagttgttggcgaattggcaagtattaaatttgacaattctgtcttagtcaaccctgctaatgcgcaattaacaaatggcggtggagctgcccgtgcaattgcaaaattagctggtccaaaataccaagagtactgtaatagtgtggctcctatttcaggaccgcttaccacggactcttttgatgccaagaaacttggtgtagcctgcatcttgcatgtagtgccacccaaaggttctgaccctaatgtacaagaactcctgtatcaagcttacaagagtatccttactgaaccagcacactatgttatacccatactaggtgctggtatctttggatgtaacccagtccactctctggatgcgttcaggaaagcctgtccaagtgacataggtcgtgtcacccttgtcactatgaacaaaaaccatttgcaggtgtgggatgctctcaacaggatcattgtacgtaccactactgattatgatcaagtcaccaccaaggcccttacaccccagggagtgttagaagccaatctctttgatggtgaggactttgttcaagaaccaaaacctggtcaaatctaccttgaggttactgaagaagttcagaaccaagccaaggaacttgaccttaatcttcagcaatactgcgtctacctgaagacttgccaccataaatgggttgtgagtcgtacgaatgggttgatgcatctaaaacaaaaagataacaattgttttgttagtgcaggtgtaaacctgtttcaaaacactgcttatcaacttagacctgctattgatgctctctatagggagtatctcaatggtaatccaaaccgatttgttgcttggatttatgcatccacaaaccatcgtgttggtgagatgggctgtccacagcaagttatttctttgctcgttagtaactctgacgcagcattctcagcaactacagcctgttgcaacacctactttaatcacacaggtgttatttcagtagcttgcgaatatgacccaatacaaccaaaggtctactgcatgaagtgtgacgtgtggactccctttacaccccagagtggaaaaggtgcagttgcaattggcacttctgcagatgaacctaccggtcctgccattaaatttgccgcagctcactgctggtacactaatggtaagaaaacagttaatggctatgacactaaagctaatgttgtagctacctatcataggtttgacgtgcctaagcctcaacttgtcgaggacgtggttgcgctgcctactaaaaatgactttgaggttctcaatgttgaagaactgccgcaggatagtgtgctccatttggacccacctcctgtacaggctttacaacctaaggctaaccaacacgttgagactctagaaaacccagattatctggacattttggatctttggattcgtaaacccaaattcatccttgtaaagtcatggagtgttttgggtagagcactatgtaaggcaggtagagttgtctttgtcagtgcttctcttttgacccgtttctacaattaccttgtagagattggtgctcttgactcaacaataaggttgtcaatcgatcttacctgtaaatttgttagaacggttctcccatcgtctaacactgtacgcaaaacttgtcttggtctgtattattcagcccagacaatttttgtttctttagcaccattccttatgttaccagctgtagctagtctgcttaattcaggctatacaattggcacatatttgtatgcaaaaactggctggccttgtaattacaatgccacgcaacactttgattataattcttactgtgcaggtgacttggtttgtcaagcttgttttgacggtcaagactccctacatttgtatccgcatttacgtgttaatcagcagccccttcaggccactgactacactgtttatgcgctttcactaatactactattagctaacatgactcttgtcatgggcacgctaatagttactttctttgtgaacttctatggtgtgcaaataccattttatggtacacttttgatagattatcagtccgcgctggtgatgactttctcagtgtactatttttataaggtaatgaagtttttccgccatctcacatatggatgtaaaattccaacgtgtgtggtatgtgctaaacttcgtaccccacctactataacagttgagactgtcgttcagggcaggaaatacccatctgttattgaaacaaatggcgggtttacaatttgtaaagagcacaacttctattgcaaggactgctcactacaaacacccggcactttcatcccgacagaagctattgagtcgctctcacgagctaccaggcttagtgtcaaaccaacagcaccagcattcttactagctagagatgttgagtgccaaactgatgttgtcgttgctcgcgcaatgcataaccaaaatgcgcatgtgtgcatttcaaaatactctgatattcgtaccgttgaccaactacttaaacctacaccactgttttcatacacccccgatgtcatcatcgcggcagactttgacaacagaggtagtcttaagacagctaaagaattagctgtggttttgtcaatggaccttaaacgtactataattatcattgatcaggcctattctagacccattgataattatcaggaagttgcttctcgtattgagaagtattacccagttgcaaagatcacacccacaggtgacatctttacagacattaagcaagcgaccaatggccaagctagtgactctgctattaatgcagctgttttggctgtccaacgtggtcttgattttacaattgacaaccctaacaacatattgccacattacgcctttgacttttcaacccttactgcagaagaccagtctaccattttggagagtggttgtgctaaaggcaatctcaaaggcactaatgtcggtgttgttctttcagctagccttgttacacgtcttagtcagcaggctacacgtgtgatcgctaatgctgcttcacgtaatggtgttacttgcgccgttactccatctacacttgttatgcgtgggaatattgcaacacagcccttgactcgcatcaaagctggtgcacctcccatgcgtcaaaaaatcttatgtgttatcctggcacttgctattgtgtactttgctgctatggcttttggctttttggcaagtcaaattacgcttaatacagtgcctacgattaaatctgatatccgcgcctctaccttctacgtcgttagagatggagtcctggatactgttcgttcaaatgacaagtgttttgcaaataagtttttggcatttgatagcttcattcaagcaccttacactaattcacctgactgtccagttgttgtgggagttgttgatgtaacgacgcactctattcctggaattccagcaggtgtcattcatagagacggtctcatacttaacatttatgaacagtctctttatgaaacccaacagcgtcagtctatggttagggatgcgttgtcacttaagacagcaaacctctttaacctaggcaagcgcgttgtagtaggatacactcaacatgaagttgttgtgggtacctcctattttaattctcctgcactttttaacgcaaagtgtaccttcttacaatatcaggacactagacaactctattgctatgatactgtttctactgaacataagctttactctgatgtgcttcctcacgttgagtataaggctattgacattaatggtgatcttgttcctttcaagataccagagcaaataatgttctatccacatattgtgcgctatactagcaattcctattgccgtatggggcattgttttaatactaaccctggtatttgcatttcatttacggatgaatttccgtatagtgtaaatgtcaaacccggtgtatactgtgctgataccgctttgcagttggtttcaaaccttgttttgggcactgtatctggtattcacatctttacatcaacagctgcattgcttggatccactattgtgatcatactatgcgtcgttgctgttctcgcagttcagcgattcttcaaggagtacacgacttttgttatgtacacttgtggtcttgcccttgtcaacattgtgggcattgcacttatgtacaagtgccttgtcttcgcgattttctattatgcaatctatctttactttgtccttactttcccctcctttaagaggaatgtggcattgttttacttcgctgtagtgatcgtgccgcacgtgagcaacatgcagttgcttgcgctcattgtgtgtagcattatctactttctctacacttatgttcatactgtagctaagacagctgggaaattttcttccttcttagacgcagctaaagctacttttgtcattgacaatgataagtacgtgttgcttaaagaccttgctggtgctgaatttgaccagtatctggcttcttacaacaagtacaaatacttttctggtactgcttctgataaggattatgataaggtctgtatggcatttcttgccaaggctttgtcatcttttcgtgaaggaggcggttcacagttgtacacaccacctaaatttgcagttgttcagagtcttaagaccaagctgcaagcaggtatcaaaatcctcctgcacccctcaggtgtagttgagcgatgcatggtctcagttgtctacaatgggtctgcattgaatggcatctggcttaagaatgtcgtctactgcccacgccatgtaattggaaaattccgtggtgaccagtggactcacatggtctcaattgctgattgccgcgactttatagtcaagtgtccaacacagggtattcagctaaatgtccaatcagttaagatggtaggagctctcctccagttaactgttcataccaacaacacagccactccagactataagtttgaaaggcttcaaccagggtcatcgatgacaattgcttgtgcctatgatggcattgtacggcatgtctatcacgtggtccttcaacttaataatcttatttatgcaagcttccttaatggagcttgtggtagtgtgggttacactcttaggggtaaaacactctacttacattacatgcaccacattgagtttaataacaaaactcatagtggtacagatcttgaaggtaacttctatggtccctatgtggatgaggaagttattcagcagcaaacagcattccagtattacactgataatgttgttgctcaattatatgcacacttactgactgttgatgccagaccaaaatggctgacacaatctcagataagtatcgaggattttaactcatgggctgctaacaattcctttgctaacttcccatgtgaacaaactaatatgtcctacattatgggactctcgcaaacaacgcgagttccggtagaacgtgttctcaataccattatacagctaaccaccaatagagatggtgcttgtattatggggtcttatgatttcgagtgtgattggacaccagagatggtgtacaatcaggctccaatctcactgcagtcaggagtagttaagaaaacttgtacgtggttcttccacttcttgtttatggctattaccatgctactcgctgccatgcatgtcttccctgtacacttgtactcaatagtactgccatgctttactgtcgtggcattcctgttgactttaaccattaaacacactgtagtgtttaccactacatacttgcttccgtcacttttgatgatggttgtaaatgctaacactttttggataccgaacacatttctgcgcacctgctacgaaactatattcggttccccaattgctcagcgactgtatggttacactgttgctctttatatgctaatctatgctggacttgcaatcaactatacgttgaaaacattccagtatagagcaacttcattcttatctttttgcatgcagtggtttcaatatggttatgttgcacacattgtgtacaaactgattaataaaccctggacagaatcactactcttcacagcctccacaatgctaaccagccatcctttgttggctgctcttagctggtggctagctggtcgtgtaactctgcccattatcatgcctgacttagctattcgcgttttggcgtataacgtcattggctatgtcatgtgtgtccgatttggccttatgtggcttgcaaatcggttcacaactgtacctatgggcacatatcagtatatggtgtctgtagagcaacttaagtacatgatggcagttaagatgtccccaccgcgtaatgcgtttgaggtgcttatagccaacattagacttcttggtttgggtggaaaccgtaacattgctgtttctactgtccaaaacaaaattcttgatgcaaaagctactgctgttgttgttgctaaccttctcgaaaaggctggtgtcacaaacaagcacgctgtttgcaaaaagattgtgaaactccacaatgatacccttaaagccaccacttatgaggaggttgaggtagcacttgtgaaacttctttctcacataattgagttcttgccaactgatcaggtagatgcttacctagctgatgcggccaatgctcaacatgttaatacctattttgacaacttgcttgagaacaaagctgttgttcaggctgttgccgatatcaacattaatctggattcttatagaatttataaggaggcagatgctatttacaaacgatctgttgagatgaacgaatctctacaggagcaaaagaaaaagcttaaagctgttaacattgcaaaggcggaatgggagcgtgaggctgcttctcagcgtaagctcgaaaagcttgctgatgctgctatgaagtctatgtatcttgcagaacgtgctgaggatcgtcgcattaaactaacctctggacttactgcaatgctttaccatatgcttagacgtcttgactcagatagggtaaaagctctgtttgagtgcgctaaggcacaaatcttgccaatacatgctgtagttggaatttctaatgacaaccttaaagttatttttaacgataaggatagctactctcattatgtagatggcaacacacttatacataagggagttcgttacactattgtgaagaaactctccttagataatgcacctattgaaggcgtaccagaagaattccctgtggtcgttgagactgttagggagggtgtgccccagttgcaaaacaatgagctatgtttgcgcaatgttttcactgctcagaacacagctcaggacttcaatggcaatgaatccactgtaaaatctttttatgttactagaactggtaagaagattttggttgccattacatcaactaaagacaatcttaagactgtgacctgccttactgagaccggtaagacagtccttaatttggaccctcctatgcgcttcgcacataccgtaggtggaaaacagtctgttgtctatctctattttattcagaatattagttcactcaacagaggtatggttattggccacatctctgaaactactatccttcaggcaagtggcactcaaattgagtaccagcaaaatgcctctcttttgacctatttggctttcgctgtagaccctaaaacagcctaccttaagcatcttgctgatggtgggtctcctatacagggttgtattcagatgattgctactatgggtcctggatttgcagttactactaaaccacaacctaatgagcaccagtattcttatggtggtgcttcaatctgtctttattgccgtgctcatataccacatcctggtgttgatggacggtgcccctacaaaggccgctttgttcacattgacaaagataaggaacctgtttccttcgccttgactcatgagccatgcagttcttgtcagcggtgggttaattatgactgcacctgcggatctagtctgcagaattcggcttatttaaacgagtaacgggttctagtgacgcccggctagaacccctgcagcctgggactcaaccagatgctgtaaaaagggccttccatgtgcataatgatactacctctggtatattcttaagcacaaaatctaactgcgctcggtttaaaaccacacgcagtgccctgcctttacctaacaagggagaggttgaattgtactttgttactaagcagtgtgcagctaaagttttcgaaattgaggaggaatgctacaacgctattagtacagagctttatactactgatgatacatttggtgtccttgccaaaactgagttcttcaagtttgacaagatacctaatgtcaatcgccagtatttgactaaatatacactcctggacttggcttatgccttacgtcatttgtcaacatctaaggatgttattcaagaaatcttgatcaccatgtgcggcacccctgaagattggtttggggaaaattggtttgatccaattgaaaacccatccttttacaaggagttccataaacttggagatattcttaaccgctgtgttcttaatgccaataagtttgctagtgcctgtatagacgctggtcttgttggcatattaacgcccgacaatcaagacctcctgggtcagatttatgactttggagattttattattacacaaccaggtaatggatgtgtggatctagcatcctattattcttatttaatgcccattatgtccatgactcacatgttaaagtgtgagtgtatggatagtgatggcaacccacttgagtatgatggatttcagtatgacttcactgatttcaagcttggcttgttcgagaagtattttaagtactgggaccgtccttaccatcctaacactgttgaatgtccagatgaccgctgtgtattgcactgtgcgaacttcaacgttttgtttgctatgtgtatacctaatacggcatttggcaatctttgttcaagagccactgttgatggccaccttgtggttcaaacagtgggtgtacacttgaaagaacttggtatagtccttaaccaggacgttaccacgcacatggcaaatattaatctaaacactttattgcgattggtaggtgatcccaccaccattgcaagtgtctcagacaagtgtgtagatttaagaactccttgtcagaccttggctactatgtctagcgggatcgctaaacagtcagtcaagccggggcattttaatcaacatttctacaagcatttgcttgatagtaacctattagaccaacttggaatagacatgcgccacttctactatatgcaagatggtgaagcggctattacagactacagctactacaggtataatacacccacgatggtagatattaagatgttcttattttgccttgaggtggcagataagtatcttgagccctacgaaggtggatgtattaatgcacagtcagttgtggtttctaatttggacaagtcagcgggctacccctttaataagctaggtaaggctcgtaactattacgacatgactcatgccgagcaaaatcaactgtttgagtatacaaaacgcaatgttttacctacactcactcagatgaaccttaagtatgcaatttcagccaaggatcgtgctcgcactgttgcaggagtgtctataattagcaccatgactaacaggcagtaccatcaaaagatgctgaaatctatttcacttgcacgcaatcagaccatcgtgattggaacaaccaaattctatggtggttgggacaacatgttacgacgactgatgtgtaatatcaataatcccattttagtgggttgggattaccctaagtgtgatcgttctatgccaaacatgctgcgcattgccgcttcgtgcttgctagcacgaaaacacacctgctgtaaccaaagccagcgattctatcgtttggctaatgaatgttgccaagtactatcagaagttgtagtctctggtaacaacctctatgtaaaaccaggtggtactagcagtggtgatgcaaccacagcttacgccaactcggtctttaacatcttacaggtggtttctgctaatgtagccacctttttatcaacttccaccacgacacatcttaataaagacatagcggacttgcatcgtagtctttatgaagatatttatcgtggtgactctaatgatatcaccgtcatcaatagattctaccagcatctccaaagttactttggacttatgatattgtctgatgatggtgtcgcatgtatagactcagccgttgcaaaggctggagctgttgctgaccttgatggtttccgagacattttgttttaccaaaacaatgtttacatggcagattcaaagtgttggacagaaactgacatgaatgttggccctcatgaattttgctcacagcatactgtgttagcagagcatgatggtaaaccttactacttaccttacccagatgtctctcgcattctgggtgcatgcatctttgtggatgacgttaacaaggctgaccccgttcagaaccttgaacgttacatctcacttgcaattgatgcatatcctctcaccaaggttgaccctattaagggtaaagtcttctacttgttactagattacatacgtgttcttgctcaggagttacaggatggtatccttgatgccttccaatcactcactgacatgtcgtatgtaaataactttatgaatgaggccttttatgctcagatgtatgagcaaagtcctacactacaagctagcggcgtttgtgtggtgtgtaattcacccactatactgcgctgtggtgattgcattcgtcgaccactactttgttgcgtctgtgcttaccagcatgttacgcagactacacataaacgtatcattgctatcaacaactacatctgtagtgttgagaattgcaatgaggacaatgttgaaaaacttttcatttctggcactgcgatttattgtgagaatcacaaacctacgctgtgcatacccattgtagctaatggttctgtttttggtatctatcgccacactgcccgtggtagtgacgacatagacctctttaacgagcttgctacatccaactatgatactattgaaccttatcagaaggccaatcgtgcacctttatcacttatgctcttcgctgctgagaccattaaggcactcgaggagtctatcaagaagtcatatgctaccgcaactgtcaaggatgtgtatgaccaacgcttcattaaacttctatgggaacagggtaaaaagccgccacccataacgaagaaccacattttcactggctaccattttaacaagaatggaaaaacccaagttggtgattacattcttgctaaaacagatggcagtgacacttatacttacagaggaacatctacctacaaacttcaaacgggtgatgttctagtcttaatggcacatgttgtcacaccgctctcagcacccccagtgctaacgcagacaacatatgtcagaaaatcacttttacctgactctgttggtgcgtcttattatgtgcaacattttaagtcatataatgagatagctatgcagagggttacaacagtattaggcccaccaggcacaggtaagtcaacctttgctattggtttggctaagtattttcctagtgcacgtatttgctacactgcgtcttcgcatgcagcaatcgatgcactctgtgagaaagctttcaagacaatacctgtaggtcaatgcagtcgtatcgtacccacacgtacaactgttgagtgctttcaggagtttgtcgtaaataacacaactgcacagtatatcttctcgactatcaatgccttacctgacattaagtgtgacattgtggttgtagatgaggtttctatgttgaccaattatgagctctcctctgtgaatgctcgtttggtttacaatcacattgtgtatgttggtgatccttatcagttaccttcacctagaactatgcttacgtctggccagctttcgccggctgactataacgtagttactgatataatggtacatgcaggagcggatgttatgctcgacatgtgctacagatgcccacgtgaaatcgttgagacagtgtctaaacttgtctacgataataaactaaaagcggcgaaaccgaactcaagacagtgttacaagaccattgtgaactttggtcctggagacgttgctcatgagggacaatctgcctacaacgaagcacagttgcgtttcgcactcgcatttagacaacaaaagcggtgggataacgtgactttcatatctccatataatgctatgaatgtgaaagcatccttagcaggtttctctactcaaaccgttgactcttctcaaggttctgagtatgattatgttatcttttgcgtgaccactgattcagcacacgcacttaacatggctcgtttgaacgttgcccttacacgtgcaaagataggtatccttgtggtgtttaggcaggcaaacgaactttacaatagtttgcagtttgaatctattgattcacagcttcagtcgagtgctgagaaaaacctcacaccactgtttaagcgctgcggctatgagtataatggcgtccatccagctcatgctttgacctggcatgattgtggtgcagagtaccgctgtgaggagccacttgctaaattagtaggagttgccgatggcactcttatatcatacaaaaccctagtatccacacttgggtttcttccatcacttaaaattgatgcatatcataatatgttcctaacacgtgacgcgtgtcgcacctatgttcagagttggatcggcatagacgttgaagcagcacacgccataaaacctaacactggaactaacctgccattgcaaataggttttagcaccggaaagaatttttcagttactccagagggaatttgggtaaacgagcacggatcttgcactgagcccgtccctgccaaaatacctcctggagaacaatttcgtcaccttaagaaggacatgcgccatgcgcgtccttggaaggttgttcgacgtgagattgctactcatattgctgaggtagctccccacactgattatatatgctttgtcacttgggctcaccagcttgagctagcgacaatgcgctactttgtcaaactaggtatggaagagaaatgcttttgtggcaggcgggcttgtttcactaatggaactgagttcgcttgcaaagtacatcattctctcaccattccacaatgtgattatgtgtacaatccattcctcatcgacgtggctacgtggggattctcgggacggctttccaccaaccatgacgcggtatgcacatatcatgctaatgcccatgttgcatcagctgatgcaatcatgacggtatgcttagctatccatgaactgttcagtactgttgactggaaccttgaatttccagtaactgctgagcaatcacaacttaacaaggcctgtcgcttagtacaggcaaactatttaaatatactactcactacaaccaaggccatggtggttcatgatattggtaacccaaaaggtatccctatcgtgcgcaaacctggtgttaaatatcacttctatgatcaagcacccattgtcaaacacgttcaaaaactaaagtacaagccagagatggaggcccgtttcaccgatggtttgactatgttttggaattgtaatgttgacacataccctgctaacgcccttgtgtgccgctacgacactcatcggcagaagcatttaattggacctaatggttcagcactatatgttaataagcatgcttttctcactcctgagatgcatacttatgctacacataaactcaacttggctccactcatctactactctaccacagattgtagtagtgaacagcctattgttgttacctacagagattgtgtcacccggtgcaatactggaaaaactctctgtccaaatcatgctcttgaataccaagagtttattaatgcatacaatctcatggctcgccatggatttaatgtttacataccacgcaatgtcaacgtctacaactgttggcttactttcactaatctccaaaaccttgaaaacttagcttacaactgttattataagaactgcaatgctcacgttgatgggcagcttgatgtagttattaataataacgctgtatatgctaaggtcgacaataatcttgtcaaacttttcgacaaccgcactaacttacctgtctcagtggcttttgaacattacactaacaggcatacccgttcactgccaactacacagctgttatctggtttaggcgtaaccgccaccagaaatttcacggtgtggtttgacaatgatacaattttccaatacactattaatgtatctacgtatactgacatcgaccctagtacccatgttgtcctttgtgatgataggtacggaacagattggagtcagtttaaccaacttcctaatgcagtattcctcaccaaaactaaggtgaagaaaacagaaccgtttgtttgtacagcactgaccctaaatggcctcgccattgacggtgaagagctatacatctatgtacgctataacaatcaactgaccacatttgctactatttgtacacagggtagaaatgttgagcagtttatacctaaaacacctatggaaagagacttccttgagatgtctcaacagtccttcattcaacaataccaattgcaggatctgggtgttgaacacattatctatggtgatgattccagtccagtcattggcggaactcacacccttatctcactagttaaaaacaagtttgaacatcagcttgtcaaccatgtttacaacccagtccagaactgtgttgttacctcacctaacgcaagctccaagaacgtttgcactgttcttgatattcttcttgatgattacattgacatcataagacaagcacatgcctgttacacaagtaaatccaaagtattcactgtgtcaattgataaccaacaaattagattcatgctttggcatgatgagcaagtcaagacttgctatccaatcttacagtcacttaccaatggttaccagatgccatctgtgtacaaaacattggttactgacttacaaccagctgacatccctaattatcattcctacaccccccgggtgcctggagtagttaagaatgttatcaagtaccgccaacttttcaactatatagttaaaaaggataggttggcagtaccacacaatatgactgtattacacctcggagctgcgtctgcactaggtacagcaccaggttcttcagtcataaaacaaatgtttcctgaaggaactgttcttattgacctagatataagagagttcacttcagatgctaaccaaataatagttacagactacagaacttatatgccaccacaccacgtagacgtcatattctctgacctctactgttgtgatgacatacacttctttgataacctaataaggatagttaaggagaggcttgccctcggtggttctatctttgttaagataactgaacattcattctcatccgaactttactcactcgcgggttggtttgatgattatcaactattttgtacagcagtcaatgcctcgtcttcagaagcatttctatgctgttttaattatttggggcatgctaaggaaaacattaatggttttaacttacatgcttcctacattcaatggcgcaatgaaatagcgttgacaccaacctattctcctttagcggacaacccggctacggcctgtaagctaaaagcaacccctattatttcggctcgtgagttagagaagaagcctattcttcgctatcttgttgcatcaggacgccttcttgtgaggccaccagaatgcagagagctctattgattatgaccttactttgtctcgctcgagctaagtttgctgatgatctactcgatttgctcaccttcccgggtgcacatcgcttcctacacaaacctacgaggaatgacagcagtctctactcgcgggccaataactttgatgttggcgttcttcctggctaccccactaagaacgttaacctcttctcaccacttaccaactctactctgcctattaatggacttcatcggagttatcaaccacttatgctgaattgtcttactaaaataactaaccaaactctcagcatgtatctccaacctagtgagatacaaacttatagctgcggcggtgccatggttaaataccagacacatgatgcagttcgtatcattttagacctcattgccactgaccgcatttctgttgaagtcgttggccaagctggtgaaaattatgtgtttgtttgtagtgatcagtttaactacaccactgcattacacaactccactttcttctcacttaattctcagctttattgcttcactaataacacctatttaggtattcttccacctgatttaactgactttacggtctatcgtactggtcagttctatgctaatggttacctcttaggtactttacctattactgttaactatgttaggttgtatcggggtcaattgtcggccaacagcgcccactttgcccttgcaaaccttaccgatacactcataacacttaccaatactactatatcgcaaatcacctattgtgataagtcagtagttgattcaatagcatgccagcgctcttctcatcaagtagaggatgggttttactctgaccctaaatctgccgttagagctaggcaacgcacaattgttacactacctaagctccctgagcttgaagtagtgcagttaaatatttctgcacacatggattttggcgaagccagacttgatagtgtcaccatcaatggtaacacatcctattgtgtcactaagccttacttcaggcttgaaactaactttctgtgcagaggctgcactatgaatctgcgcactgatacttgtagttttgacctgtcagcagtaaacaatggcatgtcattttctcaattctgtctaagcactgaatctggtgcttgtgagatgaaaattattgttacctacgtatggaattacttgctaaggcagcgtttgtatgttacagctgtagagggccagactcacactggaaccacttcagtacatgcaacagacacttctagtgtaatcactgatgtctgcactgactacactatctatggagtctctggtactggcattattaagccatcagatctcttattgcacaatggcatagcattcacctcccccacaggtgagctttatgcatttaaaaatataaccactggcaaaaccctccaggtcttaccgtgtgaaaccccttctcaactgattgtgataaacaacaccgttgtcggtgctatcacatccagtaactcaactgaaaataataggtttactactactatcgtcacacctactttcttttattccacaaatgccaccactctcaactgcactaagcctgttttgtcctatggacctatcagcgtgtgtagtgatggtgcaattgctggaacatccacattacagaatactcgaccatccatagtttcactatacgatggcgaaattgaaataccatctgcattttctctttctgtccagacagagtatttgcaagttcaagcagagcaagttatagttgattgtccccagtatgtatgcaatggcaatagccgttgtctacaattactggcacaatacacctcagcttgctctaatattgaagttgctctgcattcctcagcacagctggacagcagagagattataagtatgtttaaaacatcaacacaatccttgcagttggctaatattaccaacttcaaaggcgactacaattttagcagtatactaacctccagagttggtggtagatctgctattgaagaccttctttttaataaagttgttactagtggccttggcactgttgatcaggactacaaatcctgttctaggaacatggccatcgctgatttagtttgttcccagtattacaatggcatcatggttctacctggtgttgttgatgctgagaaaatggcaatgtatactggctctcttactggagctatggtatttgggggactgactgctgcagcggcaataccattcgccactgcagtacaagcccgcctcaattatgtcgcactgcaaacaaatgtactacaagaaaaccagaaaattcttgcagaatcatttaaccaagcagttggcaatatatcacttgcactatcttctgttaatgatgccatccagcaaacttctgaggctcttaacactgtagctattgctattaaaaagattcaaacagttgttaaccagcagggtgaggcactatcacacctgactgcacagctgtcaaataatttccaagcaatttcgacttctattcaagacatttacaaccgtcttgaggaagtagaggctaaccagcaagttgaccgtctcatcaatggacggttggctgcacttaatgcatatgttactcagctactcaatcagatgtctcagattagacaatcccgattgctagctcagcaaaagattaatgagtgtgtcaaatctcagtcgcccagatacggtttctgtggaaatggcacacacatcttctcacttactcagactgcaccaaacggcatatttttcatgcatgcagtacttgtacccaacaaattcacacgtgtcaacgcttctgcgggtatttgtgtggataatacgagaggctactcattgcagcctcaacttatactctaccagtttaataactcctggagagttacacctagaaatatgtatgaacccagactgccccggcaagctgatttcatacaattaactgattgcagcgttacgttttataacactaccgctgctaatcttcccaatattattcctgacgtcatagatgttaatcaaacagtcagtgatattattgataatttacctacagcaacaccccctcagtgggatgttggtatctataacaacactattctcaacctcaccgttgagattaatgatctacaagagcggtctaaaaacctctcacagattgcagatcgtttacaaaactatatagacaatcttaacaatactctagttgaccttgaatggctcaacagagtggaaacttaccttaaatggccgtggtatatatggcttgccatagccctggctcttattgcatttgtgacaatcctcataacaatctttctttgcactggttgttgtggtggttgctttggttgttgtggcggttgttttggccttttctctaagaagaaaaggtataccgacgaccaaccaacaccgtcatttaagtttaaggaatggtagtcgacgactgggccgttaccatccctggacaatatattattgctatactagttgtcatctgcattggtgtggcactactttttattaacacttgcttagcttgtgttaaattattttacaagtgctacctaggggcagcatatcttgttaggcctattatagtgtactactccaagccgaaccccgtacctgaggatgagtttgtaaaagtacaccaatttcctagaaacactcactatgtctgacgcagaagagtggcaaattattgttttcattgcgatcatatgggcgcttggcgtcatcctccaaggaggctatgctacgcgtaatcgtgtgatctacgttattaaacttattctgctttggctgctccaacccttcaccctagtggtgactatttggaccgcagttgacagatcatctaagaaggacgcagttttcattgtgtccataatttttgccgtactgaccttcatatcctgggtcaagtactggtatgactcaattcgtttactaatgaaaaccagatctgcatgggcactctcacctgagagtagactccttgcagggattatggatccaatgggtacatggaggtgcattcccatcgaccacatggctccgattctcacaccagtcgttaagcatggcaagctcaagctacatgggcaagagctggccaatggcatatcagttagaaatcctccacaggatatggtgatagtgtcaccaagtgacacctttcactacacttttaagaaacctgtggaatcaaacaacgatccagaattcgctgttctgatataccagggtgaccgcgcttcaaacgctggacttcacaccataaccacttcaaaggccggtgacgctcgcctctataagtatatgtaatgtgcaactgccatctgcagctgcgagatttatatagattgtgcaataagcggcacatcagaagagacgatgttcctgagcttattgaccctctcgttaaaactcgctgttttgcttacagtctcgtggttcttgctaatgcaaatccaattgcatttagcatactacctcggaaaattcttatcaatggcgagcctttactgcttgaatatggtagcatatatggtaaagactttatcattcgaccatcactccaagtcattcttgaagatgaattaaattaaagttttgacaccaatctatcatggctgcaccagtagtccctactactgacgcgtcttggtttcaggtgctcaaagctcaaaacaaaaagtctactcatcctcagtttcgtggcaatggagttccgcttaactccgccatcaaacccgctgaaaaccatggctactggctgcgttacaccagacaaaagccaggtggcactccgattcctccatcctatgccttttattacactggcacaggtcccagaggaaatcttaagtatggtgaactccctcctaatgatacccctgcaaccactcgtgttacttgggttaaaggttcgggagctgacacttctattaagcctcatgttgccaaacgcaaccccaacaatcctaaacatcagctgctacctctccgattcccaactggagatggtccagctcaaggtttcagagttgaccccttcaacgctagaggaagacctcaggagcgtggaagtggcccaagatctcaatctgttaaccccagaggcacatgcaatcagcccaggaaacgcgaccaatctgcacctgctgcggtacgtcgtaaaacccaacatcaagctcctaagcggactttacccaagggtaaaaccatttctcaggtatttggcaaccggtctcgcactggcgccaatgtcggctctgcagacactgagaagacgggtatggctgatcctcgcatcatggctctagccagacatgtgcctggtgttcaggaaatgcttttcgctggccaccttgagagcaactttcaggcgggggcaattacccttaccttctcttactcaatcacagtcaaggagggttctcctgactatgagagacttaaggatgcgctcaacacggtcgttaaccagacctatgagccacccaccaaaccaactaaggacaagaagcctgacaaacaagaccagtctgctaaacccaaacagcagaagaaacctaaaaaggtaactctgccagcagacaaacaggattgggagtgggatgatgcttttgagataaagcaggaatcagcagcgtagacatcaatctatgtctctctacacacacccaaccacacttaaacatctctttgattccagagagtcatattgtatagccagagagccagtcagagggcgctatcatgcaaactagggctggctactctagcacagaatcacatcccgataatcaacagtgctagaaggttgattataccatttaatatgccgaggccacgcggagtacgatcgagggtacagcataatctcaacttttgttgagccacaattttaatcctaattggagaaggtcaaaggactgtactacttttgtaggtgtagcagtcgcccagtgggaaagcgccaactaggttacaattgtggtggggacaaattaggggaaattaaattggcttataggggggatggagca

We claim:

1. A method, comprising:
   isolating porcine epidemic diarrhea virus (PEDV)-infected cells away from cell-free PEDV viral particles in a population of cells in a culture medium;
   extracting or eluting PEDV proteins and antigens from the isolated PEDV-infected cells with a detergent-containing solution to form a first solution comprising detergent and isolated PEDV proteins and antigens; and
   adding an adjuvant to the first solution to form a second solution comprising the isolated PEDV proteins and antigens, the detergent and the adjuvant.

2. The method of claim 1, further comprising allowing the population of cells to incubate for a time period sufficient to result in one or more replicated PEDV viral particles being released into the culture medium.

3. The method of claim 1, wherein the detergent-containing solution comprises a non-ionic detergent.

4. The method of claim 3, wherein the non-ionic detergent is poly(ethylene glycol) p-isooctyl-phenyl ether, octylphenoxypolyethoxyethanol (Nonidet P-40), 4-(1,1,3,3-tetramethylbutyl)phenyl-polyethylene glycol (Triton X-100), or a combination thereof.

5. The method of claim 3, wherein the detergent-containing solution comprises a detergent at a concentration of greater than zero to 5% in solution.

6. The method of claim 3, wherein the detergent-containing solution comprises a chelating agent at a concentration of greater than zero to 0.5M in solution.

7. The method of claim 1, wherein extracting or eluting PEDV proteins and antigens comprises extracting or eluting PEDV proteins and antigens for about 0.1 to about 15 hours.

8. The method of claim 7, wherein extracting or eluting PEDV proteins and antigens is performed at a temperature of from 0° C. to 25° C.

9. The method of claim 7, wherein extracting or eluting PEDV proteins and antigens comprises extracting or eluting PEDV proteins and antigens for from 0.1 hours to 15 hours at 4° C.

10. The method of claim 1, wherein the proteins and antigens include PEDV envelope proteins.

11. The method of claim 1, wherein the first solution of isolated PEDV proteins and antigens has a concentration of PEDV proteins and antigens greater than a concentration of PEDV proteins and antigens in the culture medium that contained the population of infected cells.

12. The method of claim 1, further comprising adding an excipient to the first solution or the second solution.

13. A method, comprising:
isolating PEDV-infected cells away from cell-free PEDV viral particles in a population of cells in a culture medium;
allowing the population of cells to incubate for a time period sufficient to result in one or more replicated PEDV viral particles being released into the culture medium;

extracting or eluting PEDV proteins and antigens from the isolated PEDV-infected cells with a detergent-containing solution to form a solution of isolated PEDV proteins and antigens; and adding an adjuvant to the solution of isolated PEDV proteins and antigens, to form an immunogenic composition comprising PEDV proteins and antigens, cell fragments, the detergent and the adjuvant.

14. A composition comprising isolated PEDV proteins and antigens from claim 1, an adjuvant, and a detergent made by the method of claim 1.

15. The composition of claim 14, comprising PEDV proteins and antigens, cell fragments, the detergent and the adjuvant.

16. A method of vaccinating a subject, the method comprising administering to the subject the second solution from claim 1 or a composition comprising the second solution of isolated PEDV proteins and antigens from claim 1.

17. The method of claim 16, wherein the subject is a porcine subject.

18. A method of generating an immune response in a porcine subject, the method comprising administering to the subject the composition of claim 15.

19. The method of claim 6, wherein the chelating agent is ethylenediaminetetraacetic acid.

20. The composition of claim 14, wherein the composition comprises the isolated PEDV proteins and antigens, the adjuvant, the detergent, and ethylenediaminetetraacetic acid.

* * * * *